United States Patent
DiMarchi et al.

(10) Patent No.: US 9,145,451 B2
(45) Date of Patent: Sep. 29, 2015

(54) GLUCAGON SUPERFAMILY PEPTIDES EXHBITING G PROTEIN COUPLED RECEPTOR ACTIVITY

(75) Inventors: Richard D. DiMarchi, Carmel, IN (US); Lianshan Zhang, Princeton Junction, NJ (US)

(73) Assignees: Indiana University Research and Technology Corporation, Indianapolis, IN (US); Marcadia Biotech, Inc., Nutley, NJ (US)

( * ) Notice: Subject to any disclaimer, the term of this patent is extended or adjusted under 35 U.S.C. 154(b) by 0 days.

(21) Appl. No.: 13/697,017

(22) PCT Filed: May 10, 2011

(86) PCT No.: PCT/US2011/035912
§ 371 (c)(1),
(2), (4) Date: Nov. 9, 2012

(87) PCT Pub. No.: WO2011/143208
PCT Pub. Date: Nov. 17, 2011

(65) Prior Publication Data
US 2013/0116172 A1  May 9, 2013

Related U.S. Application Data

(60) Provisional application No. 61/334,433, filed on May 13, 2010.

(51) Int. Cl.
*A61K 38/26* (2006.01)
*C07K 14/605* (2006.01)
*A61K 47/48* (2006.01)

(52) U.S. Cl.
CPC .............. *C07K 14/605* (2013.01); *A61K 38/26* (2013.01); *A61K 47/48215* (2013.01); *A61K 47/48246* (2013.01)

(58) Field of Classification Search
CPC .................................................... A61K 38/26
See application file for complete search history.

(56) References Cited

U.S. PATENT DOCUMENTS

| | | |
|---|---|---|
| 4,275,152 A | 6/1981 | Esders et al. |
| 5,359,030 A | 10/1994 | Ekwuribe |
| 5,510,459 A | 4/1996 | Smith et al. |
| 5,512,549 A | 4/1996 | Chen et al. |
| 5,665,705 A | 9/1997 | Merrifield et al. |
| 5,783,674 A | 7/1998 | Geysin et al. |
| 6,191,102 B1 | 2/2001 | DiMarchi et al. |
| 6,329,336 B1 | 12/2001 | Bridon et al. |
| 6,583,111 B1 | 6/2003 | DiMarchi et al. |
| 6,677,136 B2 | 1/2004 | Marshall et al. |
| 7,192,922 B2 | 3/2007 | Shannon et al. |
| 7,211,557 B2 | 5/2007 | DiMarchi et al. |
| 7,576,059 B2 | 8/2009 | Jonassen et al. |
| 2003/0021795 A1 | 1/2003 | Houston et al. |
| 2003/0143183 A1 | 7/2003 | Knudsen et al. |
| 2003/0204063 A1 | 10/2003 | Gravel et al. |
| 2004/0002468 A1 | 1/2004 | Wadsworth et al. |
| 2004/0235710 A1 | 11/2004 | DeFelippis et al. |
| 2005/0070469 A1 | 3/2005 | Bloom et al. |
| 2005/0095679 A1 | 5/2005 | Prescott et al. |
| 2005/0124550 A1 | 6/2005 | Peri |
| 2005/0153890 A1 | 7/2005 | Pan et al. |
| 2005/0288248 A1 | 12/2005 | Pan et al. |
| 2006/0003417 A1 | 1/2006 | Pan et al. |
| 2006/0003935 A1 | 1/2006 | Pan et al. |
| 2006/0171920 A1 | 8/2006 | Shechter et al. |
| 2006/0210534 A1 | 9/2006 | Lee et al. |
| 2006/0252916 A1 | 11/2006 | DiMarchi et al. |
| 2006/0286129 A1 | 12/2006 | Sarubbi |
| 2007/0042956 A1 | 2/2007 | Johansen et al. |
| 2007/0060512 A1 | 3/2007 | Sadeghi et al. |
| 2007/0173452 A1 | 7/2007 | DiMarchi et al. |
| 2007/0203058 A1 | 8/2007 | Lau et al. |
| 2007/0287670 A1 | 12/2007 | Natarajan et al. |
| 2008/0125574 A1 | 5/2008 | Sheffer et al. |
| 2008/0318837 A1 | 12/2008 | Quay et al. |
| 2009/0036364 A1 | 2/2009 | Levy et al. |
| 2009/0054305 A1 | 2/2009 | Schlein et al. |
| 2009/0062192 A1 | 3/2009 | Christensen et al. |
| 2009/0074769 A1 | 3/2009 | Glaesner et al. |
| 2009/0137456 A1 | 5/2009 | DiMarchi et al. |
| 2009/0181885 A1 | 7/2009 | Bloom et al. |
| 2009/0186817 A1 | 7/2009 | Ghosh et al. |
| 2009/0192072 A1 | 7/2009 | Pillutla et al. |

(Continued)

FOREIGN PATENT DOCUMENTS

| | | |
|---|---|---|
| CA | 2024855 | 3/1992 |
| EP | 0220958 | 5/1987 |

(Continued)

OTHER PUBLICATIONS

Kawamata et al., J. Biol. Chem. 278: 9435-9440, 2003.*
"Novel Glucagon-Based Peptides—Virtues of Combinatorial Pharmacology," AAPS 2005, San Francisco, California.
Ahn, J.M. et al., Development of potent truncated glucagon antagonists, *J. Med. Chem.*, 44(9): 1372-9, Apr. 26, 2001. (Abstract).
Ahn, J.M. et al., A new approach to search for the bioactive conformation of glucagon: positional cyclization scanning, *J. Med. Chem.*, 44(19): 3109-16, Sep. 13, 2001.

(Continued)

*Primary Examiner* — Gyan Chandra
(74) *Attorney, Agent, or Firm* — Barnes & Thornburg LLP

(57) ABSTRACT

Provided herein are glucagon superfamily peptides conjugated with GPCR ligands that are capable of acting at a G protein-coupled receptor. Also provided herein are pharmaceutical compositions and kits of the conjugates of the invention. Further provided herein are methods of treating a disease, e.g., a metabolic disorder, such as diabetes and obesity, comprising administering the conjugates of the invention.

21 Claims, 1 Drawing Sheet

(56) References Cited

U.S. PATENT DOCUMENTS

| | | |
|---|---|---|
| 2009/0221485 A1 | 9/2009 | James et al. |
| 2010/0009907 A1 | 1/2010 | Pittner et al. |
| 2010/0190699 A1 | 7/2010 | DiMarchi et al. |
| 2010/0190701 A1 | 7/2010 | Day et al. |
| 2011/0065633 A1 | 3/2011 | DiMarchi et al. |
| 2011/0098217 A1 | 4/2011 | DiMarchi et al. |
| 2011/0166062 A1 | 7/2011 | DiMarchi et al. |
| 2011/0190200 A1 | 8/2011 | DiMarchi et al. |
| 2011/0257092 A1 | 10/2011 | DiMarchi et al. |
| 2011/0288003 A1 | 11/2011 | DiMarchi et al. |

FOREIGN PATENT DOCUMENTS

| | | |
|---|---|---|
| EP | 0479210 | 4/1992 |
| EP | 0815135 | 9/1996 |
| EP | 1695983 B1 | 8/2006 |
| EP | 2036539 A1 | 3/2009 |
| EP | 2036923 A1 | 3/2009 |
| EP | 2398483 | 8/2010 |
| EP | 2300035 | 1/2012 |
| WO | WO96/29342 | 9/1996 |
| WO | WO9707814 | 3/1997 |
| WO | 97/29180 | 8/1997 |
| WO | 98/11126 | 3/1998 |
| WO | 98/19698 | 5/1998 |
| WO | WO 9824464 | 6/1998 |
| WO | WO 9946283 | 9/1999 |
| WO | WO 0020592 | 4/2000 |
| WO | WO00/42026 | 7/2000 |
| WO | WO 0058360 | 10/2000 |
| WO | 01/83527 | 11/2001 |
| WO | WO 0181919 | 11/2001 |
| WO | 01/98331 | 12/2001 |
| WO | WO 0210195 | 2/2002 |
| WO | WO0213801 | 2/2002 |
| WO | 02/48183 | 6/2002 |
| WO | WO 02100390 | 12/2002 |
| WO | WO03/011892 | 2/2003 |
| WO | 03/020201 | 3/2003 |
| WO | WO03022304 | 3/2003 |
| WO | WO 03026635 | 4/2003 |
| WO | 03/035099 | 5/2003 |
| WO | WO03/058203 | 7/2003 |
| WO | WO 03082898 | 10/2003 |
| WO | 03/103572 | 12/2003 |
| WO | WO 03103697 | 12/2003 |
| WO | WO 03105760 | 12/2003 |
| WO | WO2004000354 | 12/2003 |
| WO | 2004/022004 | 3/2004 |
| WO | 2004/067548 | 8/2004 |
| WO | WO 2004078777 | 9/2004 |
| WO | 2004/093823 | 11/2004 |
| WO | 2004/105781 | 12/2004 |
| WO | 2004/105790 | 12/2004 |
| WO | WO 2004103390 | 12/2004 |
| WO | WO 2005082928 | 9/2005 |
| WO | WO 2006086769 | 8/2006 |
| WO | WO 2006121904 | 11/2006 |
| WO | WO2006124529 | 11/2006 |
| WO | WO2006134340 A2 | 12/2006 |
| WO | 2007/022123 | 2/2007 |
| WO | WO 2007028632 | 3/2007 |
| WO | WO2007028633 | 3/2007 |
| WO | 2007/056362 | 5/2007 |
| WO | 2007/100535 | 9/2007 |
| WO | WO 2007109354 | 9/2007 |
| WO | WO 2008021560 | 2/2008 |
| WO | WO 2008022015 | 2/2008 |
| WO | WO2008023050 | 2/2008 |
| WO | WO 2008076933 | 6/2008 |
| WO | 2008/086086 | 7/2008 |
| WO | 2008/101017 | 8/2008 |
| WO | WO2009030738 A1 | 3/2009 |
| WO | WO2009030774 A1 | 3/2009 |
| WO | WO2009034117 A1 | 3/2009 |
| WO | WO2009034118 A1 | 3/2009 |
| WO | WO2009034119 A1 | 3/2009 |
| WO | WO2009035540 A2 | 3/2009 |
| WO | 2009/058662 | 5/2009 |
| WO | 2009/058734 | 5/2009 |
| WO | 2009/095479 | 8/2009 |
| WO | 2009/099763 | 8/2009 |
| WO | 2009/155257 | 12/2009 |
| WO | 2009/155258 | 12/2009 |
| WO | 2010/011439 | 1/2010 |
| WO | 2010/071807 | 6/2010 |
| WO | 2010/080605 | 7/2010 |
| WO | 2010/096052 | 8/2010 |
| WO | 2010/148089 | 12/2010 |
| WO | 2011/075393 | 6/2011 |
| WO | WO 2011087671 | 7/2011 |
| WO | WO 2011087672 | 7/2011 |
| WO | 2011/094337 | 8/2011 |
| WO | WO2011119657 | 9/2011 |
| WO | WO2011143208 | 11/2011 |
| WO | WO2011143209 | 11/2011 |
| WO | WO2011163012 | 12/2011 |
| WO | WO2011163473 | 12/2011 |

OTHER PUBLICATIONS

Althage et al.,JBC "Targeted Ablation of GIP-Producing Cells in Transgenic mice reduces obesity and insulin resistance induced by a high fat diet" 2008).

Andrews et al., "Forming Stable Helical Peptides Using Natural and Artificial Amino Acids", *Tetrahedron* 55: 11711-11743, (1999).

"Application of Chemical Biotechnology to Optimization of Endocrine Hormones," Carothers Lecture, Mar. 22, 2007.

Azizeh et al., "Pure glucagon antagonists: biological activities and cAMP accumulation using phosphodiesterase inhibitors," Peptides 1997, vol. 18, No. 5, pp. 633-641.

Azizeh et al., "The Role of Phylalanine at Position 6 in Glucagon's Mechanism of Biological Action: Multiple Replacement Analgues of Glucgon," J. Med. Chem., vol. 40, No. 16, 1997, pp. 2555-2562.

Azizeh et al., "Topographical amino acid substitution in position 10 of glucagon leads to antagonists/partial agonists with greater binding differences," J. Med. Chem., vol. 39, No. 13, Jun. 21, 1996, pp. 2449-2455.

Battersby et al., "Diketopiperazine Formation and N-Terminal Degradation in Recombinant Human Growth Hormone", *International Journal of Peptide & Protein Research* 44: 215-222, (1994).

Biotechnology—A Basis for Better Health & Economic Prosperity, Ohio State University presentation, Aug. 28, 2010.

"Biotechnology—A Basis for Better Health & Economic Prosperity," Indiana University television presentation, Nov. 2010.

Blache et al., "Development of an oxyntomodulin/glicentin C-terminal radioimmunoassay using a "thiol-maleoyl" coupling method for preparing the immunogen," Anal Biochem 1988 173(1):151-159 (1988), abstract only.

Chabenne et al., Optimization of the native glucagon sequence for medicinal purposes, J. Diabetes. Sci. Technol., 4(6): 1322-31, Nov. 1, 2010.

Chia et al., "Exogenous glucose-dependent insulinotropic polypeptide worsens post-prandial hyperglycemia in type 2 diabetes," Diabetes, 58: 1342-1349 (2009).

Collie et al., "Purification and sequence of rat oxyntomodulin," Proc. Natl. Acad. Sci. USA, vol. 91, pp. 9362-9366, Sep. 1994.

DatabaseEMBL, Jul. 16, 2007, Richard DiMarchi and David Smiley, "Human Glucagon Peptide SEQ ID No. 1," XP002631582, retrieved from EBI, Database Accession No. AGB07042, Abstract.

Jonathan Day et al., "A New Glucagon and GLP-1 Co-Agonist Eliminates Obesity in Rodents," Nature Chemical Biology, vol. 5, No. 10, Oct. 2009, pp. 749-757.

Day et al., Charge inversion at position 68 of the glucagon and glucagon-like peptide-1 receptors supports selectivity in hormone action. *J. Pept. Sci.*, 17(3): 218-25, Nov. 30, 2010.

Day, J.; Patterson, J.; Gelfanov, V. and DiMarchi, Richard Molecularbasis for Specificity in Biological Action at the Homologous Glucagon and GLP-1 Receptors, (2009) Proceedings of the 21st American Peptide Society 142-143.

(56) References Cited

OTHER PUBLICATIONS

De, Design of peptide-based prodrug chemistry and its application to glucagon-like peptide 1. Masters Thesis Aug 2007. [Retrieved from the Internet on Jun. 16, 2009: <https://scholarworksiu.edu/dspace/browse?value=De%2C+ArnabBtype=author>]; p. 8, para 2; p. 16, para 3; p. 40, para 1; p. 66, para 2; p. 77, para 1-2; p. 79, para 1.

De, Arnab; DiMarchi, Richard D. Investigation of the feasibily of an amide-based prodrug under physiological conditions. International Journal of Peptide Research and Therapeutics (2008), 14(4), 393.

De, et al., "Investigation of the feasibily of an amide-based prodrug under physiological conditions," Int. J. Pept. Res. Ther., 14, pp. 255-262 (2008).

De, A. and DiMarchi, R. Synthesis & Analysis of Peptide Hormone-based prodrugs, (2009) Proceedings of the 21st American Peptide Society 160-161.

De, A. and DiMarchi, R. Synthesis & Characterization of Ester-Based Prodrugs of Glucagon-Like Peptide 1, Peptide Science (2010) 94(4) 448-456.

DiMarchi, "Peptides—Development of Prodrug Chemistry," RBF Symposium Feb. 1-4, 2011 India.

DiMarchi, Richard, "The Use of Bioproducts in the Treatments of Metabolic Diseases" presentation slides for the Keystone Symposia (Jan. 25, 2009, Banff, Alberta).

Drucker, "Glucagon Gene Expression in Vertebrate Brain," The Journal of Biological Chemistry, vol. 263, No. 27, pp. 13475-13478, 1988.

Drucker, "The biology of incretin hormones," Cell Metabolism 3:153-165 (2006).

"Emergence of Chemical Biotechnology," Eli Lilly and Co. presentation, Jun. 22, 2009.

"The Emergence of Chemical Biotechnology & Its Application to Optimization of Endocrine Hormones," UMBC presentation, Mar. 26, 2008.

Eriksson et al., "hPEPT1 Affinity and Translocation of Selected Gln-Sar and Glu-Sar Dipeptide Derivatives", *Molecular Pharmaceutics* vol. 2, No. 3: 242-249 (May 10, 2005).

Evans et al., "Effect of β-Endorphin C-Terminal Peptides on Glucose Uptake in Isolated Skeletal Muscles of the Mouse," Peptides, vol. 18, No. 1, pp. 165-167, (1997).

Extended EP Search Report completed by the EP Searching Authority on Apr. 6, 2011 in connection with EP Patent Application No. 08845852.6.

Manta P. Feldkaemper et al., "Localization and Regulation of Glucagon Receptors in the Chick Eye and Preproglucagon and Glucagon Receptor Expression in the Mouse Eye," Experimental Eye Research, Academic Press Ltd., London, vol. 79, No. 3, Sep. 1, 2004, pp. 321-329.

Finan, B.; Gelfanov, V. and DiMarchi, R. Assessment of a Tat-Derived Peptide as a Vector for Hormonal Transport, (2009) Proceedings of the 21st American Peptide Society 321-322.

Garcia-Aparicio et al., "Design and Discovery of a Novel Dipeptidyl-peptidase IV (CD26)-Based Prodrug Approach", *J. Med. Chem.* 49: 5339-5351 (2006).

Gelfanov, et al., Discover and Structural Optimization of High Affinity Co-Agonists at the Glucagon and GLP-1 Receptors, Understanding Biology Using Peptides, Springer, pp. 763-764, Jun. 23, 2005.

GenBank entry AAH05278. Jul. 15, 2006. [Retrieved from the Internet Jun. 18, 2009: ~http://www._ncbi._nim.n. ih.gov/protein/13528972>].

Goolcharran et al., "Comparison of the Rates of Deamidation, Diketopiperazine Formation, and Oxidation in Recombinant Human Vascular Endothelial Growth Factor and Model Peptides", *AAPS Pharmsci 2000* 2(1) article 5: 1-6 (Mar. 17, 2000).

Gysin et al., "Design and Synthesis of Glucagon Partial Agonists and Antagonists," Biochemistry, 25, (1986), pp. 8278-8284.

Habegger et al., The metabolic actions of glucagon revisited, *Nat. Rev. Endocrinol.*, 6(12): 689-97, Oct. 19, 2010.

Habi, "Special Issue: Program and Abstracts for the 19th American Peptide Symposium, 2005, Abstracts of Poster Section C," (pp. 574-603) Article first published online: Jun. 10, 2005 | DOI: 10.1002/bip.20325.

Hansen et al., "Incretin hormones and insulin sensitivity," Trends in Endocrinology and Metabolism, vol. 16, No. 4, May/Jun. 2005, pp. 135-136.

Harris, J. Milton, Final Word: PEGylation—A "Sunset" Technology? <http://licence.icopyright.net/user/viewFreeUse.act?fuid=OTU1NjY3OA%3D%3D>, BioPharm International, Jun. 1, 2004.

Heppner et al., Glucagon regulation of energy metabolism, *Physiol Behav.*, 100(5): 545-8, Apr. 8, 2010.

Hjorth et al., "glucagon and Glucagon-like Peptide 1: Selective Receptor Recognition via Distinct Peptide Epitopes," The Journal of Biological Chemistry, vol. 269, No. 48, pp. 30121-30124, Dec. 2, 1994.

Hruby et al., "The Design and Biological Activities of Glucagon Agonists and Antagonists, and Their Use in Examining the Mechanisms of Glucose Action," *Curr. Med. Chem.-Imm., Endoc. & Metab. Agents*, 2001, 1, pp. 199-215.

Supplemental European Search Report issued in connection with EP Application No. 09800752 issued on Jun. 20, 2011.

Irwin et al., "Early administration of the glucose-dependent insulinotropic polypeptide receptor antagonist (Pro$^3$) GIP prevents the development of diabetes and related metabolic abnormalities associated with genetically inherited obesity in *ob/ob* mice," Diabetologia 50:1532-1540 (2007).

Joshi et al., "The Estimation of Glutaminyl Deamidation and Aspartyl Cleavage Rates in Glucagon," *International Journal of Pharmaceutics*, 273 (2004), pp. 213-219.

Joshi et al., "The Degradation Pathways of Glucagon in Acidic Solutions," *International Journal of Pharmaceutics*, 203 (2000), pp. 115-125.

Joshi et al, "Studies on the Mechanism of Aspartic Acid Cleavage and Glutamine Deamidation in the Acidic Degradation of Glucagon," *Journal of Pharmaceutical Sciences*, vol. 94, No. 9, Sep. 2005, pp. 1912-1927.

Krstenansky et al., "Importance of the C-terminal α-helical structure for glucagon's biological activity," Int. J. Peptide Protein Res., 32, 1988, 468-475.

Kukuch, A.; Patterson, J.; DiMarchi, R. and Tolbert, T. Immunoglobulin Fc-based Peptide Fusion Proteins as a Basis for Optimizing In Vivo Pharmacology, (2009) Proceedings of the 21$^{st}$ American Peptide Society 177-178.

Kulkarni, "GIP: No Longer the Neglected Incretin Twin?," Science Translational Medicine 2(49): p. 47, Sep. 15, 2010.

Lebl, Michal, "Peptides: Breaking Away: The Proceedings of the Twenty-First American Peptide Symposium", *Prompt Scientific Publishing* (2009).

Lee et al., "Synthesis, Characterization, and Pharmacokinetic Studies of PEGylated Glucagon-like Peptide-1," *Bioconjugate Chem.*, 2005, vol. 16, No. 2, pp. 377-382.

"Legacy Products—'Back to the Future'," presentation to Eli Lilly and Co., Sep. 22, 2005.

Levy et al., Optimization of the C-terminal Sequence in Glucagon to Maximize Receptor Affinity, *Understanding Biology Using Peptides*, American Peptide Society, Apr. 2006.

Levy et al., Optimization of the C-terminal Sequence in Glucagon to Maximize Receptor Affinity, Poster Presentation, Jun. 19, 2005.

Li et al., Crystallization and preliminary X-ray analysis of anti-obesity peptide hormone oxyntomodulin, *Protein & Peptide Letters*, 15(2): 232-4 (2008).

Li et al., Design, synthesis and crystallization of a novel glucagon analog as a therapeutic agent, *Acta Crystallogr. Sect. F Struct. Biol. Cryst. Commun.*, 63(Pt 7):599-601, Jun. 15, 2007.

Li et al., Structural Basis for Enhanced Solublity of a C-Terminally Extended Glucagon Analog, *Biopolymers.*, 96(4): 480 (2011).

Ma, T.; Day, J.; Gelfanov, V. and DiMarchi, R. Discovery and Structural Optimization of High Affinity Co-Agonists at the Glucagon and GLP-1 Receptors, (2009) Proceedings of the 21$^{st}$ American Peptide Society 146-147.

(56) References Cited

OTHER PUBLICATIONS

Madsen et al., "Structure—Activity and Protraction Relationship of Long-Acting Glucagon-like Peptide-1 Derivatives: Importance of Fatty acid Length, Polarity, and Bulkiness," J. Med. Chem. 2007, 50, pp. 6126-6132.
McKee et al., Receptor Binding and Adenylate Cyclase Activities of Glucagon Analogues Modified in the N-Terminal Region, Biochemistry, 25: 1650-6 (1986).
"Molecular Miracles," Indiana University, Apr. 13, 2011.
Montrose-Rafizadeh et al., "High Potency Antagonists of the Pancreatic Glucagon-like Peptide-1 Receptor," Journal of Biological Chemistry, 272(34) 21201-21206 (1997).
Murphy, et al., "Potent Long-Acting Alkylated Analogs of Growth Hormone-Releasing Factor," Pept. Res., vol. 1. No. 1, pp. 36-41 (1988).
Nogueiras et al., Direct control of peripheral lipid deposition by CNS GLP-1 receptor signaling is mediated by the sympathetic nervous system and blunted in diet-induced obesity, J. Neurosci., 29(18): 5916-25, May 6, 2009.
"Novel Glucagon Peptides That Demonstrate the Virtues of Combinatorial Pharmacology," University of Toledo, Mar. 22, 2012.
"Novel Glucagon-Based Peptides—Virtues of Combinatorial Pharmacology," Aug. 31, 2011, Berlin.
"Novel Glucagon-Based Peptides—Virtues of Combinatorial Pharmacology," European Peptide Symposium, Sep. 5-9, 2010, Copenhagen, Denmark.
"Novel Glucagon-Based Peptides—Virtues of Combinatorial Pharmacology," University of Michigan, Oct. 13, 2010.
"Novel Glucagon-Based Peptides—Virtues of Combinatorial Pharmacology," Yale University, May 13, 2011.
"Novel Glucagon-Like Chimera Peptides—Virtues of Combinatorial Pharmacology," AAPS May 2010.
"Novel Glucagon-Like Chimera Peptides—Virtues of Combinatorial Pharmacology," Keystone Conference, Apr. 12-17, 2010, Whistler, B.C.
"Novel Glucagon-Like Chimera Peptides—Virtues of Combinatorial Pharmacology," University of Cincinnati, Jun. 2010.
O'Brien, Assay for DPPIV Activity using Homogenous, Luminescent Method, Cell Notes 2005, 11:8-11.
Ouyang et al., Discovery of Bi-Functional Peptides Balanced in Glucagon Antagonism & GLP-1 Agonism. A Search for the Molecular Basis in the Inversion of Activity at Homologous Receptors, 71st Scientific sessions of American Diabetes Association 2011—Post-Conference Review and Analysis.
Ouyang et al., "Synthesis and Characterization of Peptides with Glucagon Antagonism and GLP-1 Agonism," poster presentation at the 21$^{st}$ American Peptide Symposium (Jun. 7-12, 2009, Bloomington, IN).
Pan et al., Design of a Long Acting Peptide Functioning as Both a Glucagon-like Peptide-1 Receptor Agonist and a Glucagon Receptor Agonist, *J. Biol. Chem.*, 281(18): 12506-15, Table 1, May 5, 2006.
Pan et al., "Synthesis of Cetuximab-Immunoliposomes via a Cholesterol-Based Membrane Anchor for Targeting of EGFR," Bioconjugate Chem., 18, pp. 101-108, 2007.
Patterson et al., A novel human-based receptor antagonist of sustained action reveals body weight control by endogenous GLP-1, *ACS Chem Biol.*, 6(2): 135-45 Nov. 4, 2010.
Patterson et al., Functional association of the N-terminal residues with the central region in glucagon-related peptides, *J. Peptide Sci.*, First published online Jun. 10, 2011.
PCT International Search Report for PCT/US2008/050099 completed by the US Searching Authority on Sep. 1, 2008.
PCT International Search Report for PCT/US2008/053857 completed by the US Searching Authority on Sep. 16, 2008.
PCT International Search Report for PCT/US2011/041601 completed by the US Searching Authority on Nov. 10, 2011.
PCT International Search Report for PCT/US2008/081333 completed by the US Searching Authority on Mar. 12, 2009.
PCT International Search Report for PCT/US2006/043334 completed by the US Searching Authority on Apr. 23, 2009.
PCT International Search Report for PCT/US2008/080973 completed by the US Searching Authority on Jun. 6, 2009.
PCT International Search Report for PCT/US2009/031593 completed by the US Searching Authority on Jun. 18, 2009.
PCT International Search Report for PCT/US2009/034448 completed by the US Searching Authority on Jun. 4, 2010.
PCT International Search Report for PCT/US2009/047437 completed by the US Searching Authority on Nov. 3, 2009.
PCT International Search Report for PCT/US2009/047447 completed by the US Searching Authority on Mar. 19, 2010.
PCT International Search Report for PCT/US2009/068678 completed by the US Searching Authority on May 5, 2010.
PCT International Search Report for PCT/US2010/038825 completed by the US Searching Authority on Sep. 15, 2010.
PCT International Search Report for PCT/US2010/059724 completed by the US Searching Authority on Jun. 14, 2011.
"Novel Glucagon-Based Peptides—Virtues of Combinatorial Pharmacology," Peptides Therapeutics Symposium, Oct. 21-22, 2010, La Jolla, California.
"Peptides: Frontiers of Peptide Science," Proceedings of the Fifteenth American Peptide Symposium, Jun. 14-19, 1997, Nashville, Tennessee, USA; ed. James P. Tam and Praven T.P. Kaumaya.
Perret et al., "Mutational analysis of the glucagon receptor: similarities with the vasoactive intestinal peptide (VIP)/pituitary adenylate cyclase-activating peptide (PACAP)/secretin receptors for recognition of the ligand's third residue," J. Biochem., 362 (2002), pp. 389-394.
Phillips et al., "Supramolecular Protein Engineering: Design of Zinc-Stapled Insulin Hexamers as a Long Acting Depot," J. Biol. Chem., vol. 285, No. 16, Apr. 16, 2010, pp. 11755-11759.
Robberecht, P. et al., "Receptor Occupancy and Adenylate Cyclase Activation in Rat Liver and Heart Membranes by 10 Glucagon Analogs Modified in Position 2, 3, 4, 25, 27 and/or 29," Regulatory Peptides, 21 (1988), 117-128.
M.J. Roberts et al., "Chemistry for Peptide and Protein PEGylation," Advance Drug Delivery Reviews, Elsevier BV, Amsterdam, NL, vol. 54, No. 4, Jun. 17, 2002, pp. 459-476.
Santos et al., Cyclization-Activated Prodrugs. Synthesis, Reactivity and Toxicity of Dipeptide Esters of Paracetamol, *Bioorganic & Medicinal Chemistry Letters* 15: 1595-1598 (2005).
Sapse et al., The Role of Sale Bridge Formation in Glucagon: An Experimental and Theoretical Study of Glucagon Analogs and Peptide Fragments of Glucagon, *Molec. Med.*, 8(5): 251-62, May 1, 2002.
Sato, H., "Enzymatic procedure for site-specific pegylation of proteins," Advanced Drug Delivery Reviews 54, pp. 487-504 (2002).
Schafmeister et al., "An All-Hydrocarbon Cross-Linking System for Enhancing the Helicity and Metaboli Stability of Peptides", *J. Am. Chem. Soc.* 122: 5891-5892 (2000).
"Speaking From the Gut: From Gastrointestinal Hormones to Combinatorial Therapies," Presentation to American Diabetes Association, Jun. 25, 2011.
Stigsnaes et al., "Characterisation and Physical Stability of PEGylated Glucagon," *International Journal of Pharmaceutics*, 330 (2007), pp. 87-98.
Sturm et al., "Structure-Function Studies on Positions 17, 18, and 21 Replacement Analogues of Glucagon: The Importance of Charged Residues and Salt Bridges in Glucagon Biological Activity," J Med Chem 1998, 41, 2693-2700.
Sueiras-Diaz et al., "Structure-Activity Studies on the N-Terminal Region of Glucagon," J. Med. Chem., 27, pp. 310-315, 1984.
Supplemental European Search Report issued in connection with EP Application No. 09767567.2 issued on Jun. 17, 2011.
"The Pursuit of Transformational Medicines," Keystone presentation, Jan. 29-Feb. 3, 2012, Santa Fe, NM.
"The Pursuit of Transformational Medicines," presentation to American Peptide Symposium, Jun. 25-30, 2011, San Diego, CA.
"The Pursuit of Transformational Medicines," NP2D presentation, Dec. 4, 2011.
Traylor et al., Identification of the High Potency Glucagon Agonist with Enhanced Biophysical Stability and Aqueous Solubility, Poster Abstract PY 10, pp. 505-506, Jun. 10, 2005.

(56) References Cited

OTHER PUBLICATIONS

Trivedi, D. et al., Design and synthesis of conformationally constrained glucagon analogues, *J. Med. Chem.*, 43(9): 1714-22, May 4, 2000 (Abstract).
Tschoep et al., A Novel Glucagon/GLP-1 Co-Agonist Eliminates Obesity in Rodents, Diabetes, 58 (Supp. 1): A83 (2009).
Tschoep, Matthias, "A Novel Glucagon/GLP-1 Co-Agonist Eliminates Obesity in Rodents" presentation slides for the 2009 American Diabetes Association meeting (Jun. 5-9, 2009, New Orleans, LA).
Tschoep et al., "A Novel Glucagon/GLP-1 Co-Agonist Eliminates Obesity in Rodents," American Diabetes Association Abstract No. 313-OR (2009).
Tschoep, Matthias, "Afferent Gut Hormones in the Control of Energy Balance and Metabolism" presentation slides for the 21st American Peptide Symposium (Jun. 7-12, 2009, Bloomington, IN).
Tschoep, "CNS Integration of Systems Metabolism: Target Opportunities for Diabetes Prevention and Therapy," RBF Symposium Feb. 1-4, 2011 India.
"Two for the Money" Gut Hormone Hybrids, Tschoep, ADA meeting, Jun. 25-29, 2010, Orlando, FL.
Unson et al., "Glucagon antagonists: Contribution to binding and activity of the amino-terminal sequence 1-5, position 12 and the putative alpha-helical segment 19-27," J. Biol. Chem. v264, pp. 789-794, Jan. 15, 1989, p. 792, para 1, Table 1.
Unson et al., Positively Charged Residues at Positions 12, 17, and 18 of Glucagon Ensure Maximum Biological Potency, *J. Biol. Chem.*, 273(17): 10308-12 (1998).
Unson et al., "Role of Histidine-1 in Glucagon Action," Archives of Biochemistry and Biophysics, vol. 300, No. 2, pp. 747-750, Feb. 1, 1993.
Vijayalakshmi et al., "Comparison of Helix-Stabilizing Effects of α, α-dialkyl Glycines with Linear and Cycloalkyl Side Chains", *Biopolymers* 53: 84-98 (Jan. 21, 2000).
Walensky et al., "Activation of Apoptosis in Vivo by a Hydrocarbon-Stapled BH3 Helix", *Science* 205: 1466-1470 (Sep. 3, 2004).
Ward, B.; Finan, B.; Gelfanov, V. and DiMarchi, R. Exploring the N-terminal Hydrophobic Faces of Glucagon and Glucagon-like Peptide-1, (2009) Proceedings of the 21$^{st}$ American Peptide Society 153-154.
Ward, "Fatty Acid Acylation of Peptides: Developing strategies to enhance medicines for treating metabolic disorders," Jan. 14, 2009.
Ward et al., In vitro and in vivo evaluation of native glucagon and glucagon analog (MAR-D28) during aging: lack of cytotoxicity and preservation of hyperglycemic effect, J. Diabetes Sci. Technol., 4(6):1311-21, Nov. 1, 2010.
Wibowo, Synthesis, Purification, and Biological Activity of AIB Substituted Glucagon and GLP-1 Peptide Analogues (2005-2006) vol. 45, 707=738, accessed https://scholarworks.iu.edu/dspce/handle/2022/326 on Jul. 17, 2012.
Wynne et al., "Subcutaneous Oxyntomodulin Reduces Body Weight in Overweight and Obese Subjects," *Diabetes*, vol. 54, Aug. 2005, pp. 2390-2395.
Yang, B. and DiMarchi, R.D. (2005). A Novel Approach to Resin-based Cysteine Alkylation Peptides: Chemistry, Structure and Biology, Proceedings of the XIX American Peptide Symposium, (88-89).
Yang et al., "A Novel Approach to Resin-Based Cysteine Alkylation," American Peptide Society, 2005.
Yang et al., "A Novel Approach to Resin-Based Cysteine Alkylation," poster presentation to American Peptide Society, 2005.
Yang et al., Synthesis and Biological Assessment of Sulfonic Acid-Based Glucagon Antagonists, Understanding Biology Using Peptides, American Peptide Symposia, 9(Part 6): 305-6 (2006).
Yang et al., "Synthesis and Biological Assessment of Sulfonic Acid-Based Glucagon Antagonists," American Peptide Society, 2005.
Yang et al., "Synthesis and Biological Assessment of Sulfonic Acid-Based Glucagon Antagonists," poster presentation to American Peptide Society, 2005.
Zhang et al., Design and synthesis of novel GLP1 analogues with significantly prolonged time action, Biopolymers., 80(4): 555 (2005).
Chae et al. The fatty acid conjugated exendin-4 analogs for type 2 antidiabetic therapeutics. J Control Release. May 21, 2010 (published online Jan. 20, 2010), vol. 144, No. 1, pp. 10-16; Abstract, p. 11, section 2.2; Fig 1A; p. 13, Fig. 3.
Morgan et al., G-protein coupled receptors mediating long chain fatty acid signaling in the pancreatic beta cell. Biochem Pharmacol. Dec. 15, 2009, vol. 78, No. 12, pp. 1419-1427.
Goke et al., Exendin-4 is a high potency agonist and truncated exendin-(9-39)-amide an antagonist at the glucagon-like peptide 1-(7-36)-amide receptor of insulin-secreting beta—cells. J Biol Chem. Sep. 15, 1993, vol. 268, No. 26, pp. 19650-19655; p. 19649, Table 1, Fig 1.
Estall et al., Glucagon and glucagon-like peptide receptors as drug targets. Curr Pharm Des. 2006, vol. 12, No. 14, pp. 1731-1750; p. 1733.
Chae et al., Biochemical, pharmaceutical and therapeutic properties of long-acting lithocholic acid derivatized exendin-4 analogs. Control Release, Mar. 3, 2010 (published online Nov. 10, 2009), vol. 142, No. 2, pp. 206-213.
Hirasawa et al., Free fatty acids regulate gut incretin glucagon-like peptide-1 secretion through GPR 120. Nature Medicine, Jan. 2005, vol. 11, No. 1, pp. 90-94.
Palmitic acid. Jun. 2, 2011 [online]. [Retrieved on Jul. 5, 2011]. Retrieved from the internet: <URL: http://en.wikipedia.org/wiki/Palmitic_acid>.
Finan. et al., Targeted estrogen delivery reverses the metabolic syndrome, Dec. 2012, Nature Medicine, vol. 18, NR. 12 pp. 1847.
Clardy-James. et al., Synthesis, Characterization and Pharmacodynamics of Vitamen-B12-Conjugated Glucago-Like Peiptide-1, Apr. 2013, CHEMMEDCHEM, vol. 8, NR 4 pp. 582-586.
Kroeze et al.,JBC "G-protein coupled receptors as a glance", Dec. 15, 2003, Journal of Cell Science, vol. 116, NR 24 pp. 4867-4869.
Rosenbaum et al., "The structure and function of G-protein coupled receptors", May 2009, Nature, vol. 459, NR 7245, pp. 356-363.
Okuno et al., "GILDA: GPCR ligand database for chemical genomics drug discovery database and tools update", Jan. 2008, Nuc Acid Research, vol. 35, NR special issue, pp. D907-D912.
Son et al., "Preparation and structural, biochemical, and pharmaceutical characterizations of bile acid-modified long-acting exendin-4 derivatives," J. Med. Chem., vol. 52, No. 21, Nov. 2009, pp. 6889-6896.
Lauric acid. Jun. 15, 2011 [online]. [Retrieved on Jun. 15, 2011]. Retrieved from the internet: <URL: http://en.wikipedia.org/wiki/Lauic_acid>.

* cited by examiner

Alignment of Amino Acid Sequences and Glucagon Superfamily Peptides

```
GHRH          YADAIFTNSYRKVLGQLSARKLLQDIMSR-----------------  29  SEQ ID NO: 1619
PHI           HADGVFTSDFSKLLGQLSAKKYLESLM-------------------  27  SEQ ID NO: 1622
VIP           HSDAVFTDNYTRLRKQMAVKKYLNSILN------------------  28  SEQ ID NO: 1620
PACAP-38      HSDGIFTDSYSRYRKQMAVKKYLAAVL-------------------  27  SEQ ID NO: 1621
Exendin-4     HGEGTFTSDLSKQMEEEAVRLFIEWLKNGGPSSGAPPPS-------  39  SEQ ID NO: 1618
GLP-1         HAEGTFTSDVSSYLEGQAAKEFIAWLVKGRG---------------  31  SEQ ID NO: 1603
Glucagon      HSQGTFTSDYSKYLDSRRAQDFVQWLMNT-----------------  29  SEQ ID NO: 1001
Oxyntomodulin HSQGTFTSDYSKYLDSRRAQDFVQWLMNTKRNRNNIA---------  37  SEQ ID NO: 1679
GIP           YAEGTFISDYSIAMDKIHQQDFVNWLLAQKGKKNDWKHNITQ      42  SEQ ID NO: 1004
GLP-2         HADGSFSDEMNTIIDNLAARDFINWLIQTKITD-------------  33  SEQ ID NO: 1680
Secretin      HSDGTFTSELSRLREGARLQRLLQGLV-------------------  27  SEQ ID NO: 1623
```

GLUCAGON SUPERFAMILY PEPTIDES EXHBITING G PROTEIN COUPLED RECEPTOR ACTIVITY

Incorporated by reference in its entirety is a computer-readable amino acid sequence listing submitted concurrently herewith and identified as follows: One 875,196 byte ASCII (Text) file named "44632B_SeqListing," created on Feb. 12, 2014.

CROSS REFERENCE TO RELATED APPLICATIONS

This application is a U.S. national counterpart application of international application serial No. PCT/US2011/035912 filed May 10, 2011, which claims priority to U.S. Provisional Patent Application No. 61/334,433 filed May 13, 2010. The entire disclosures of PCT/US2011/035912 and U.S. Ser. No. 61/334,433 are hereby incorporated by reference.

BACKGROUND OF THE INVENTION

Field of the Disclosure

This invention provides glucagon superfamily peptides conjugated to G protein-coupled receptor ligands that are capable of acting at G protein-coupled receptors.

BRIEF DESCRIPTION OF RELATED TECHNOLOGY

Peptide-based drugs are highly effective medicines with a relatively short duration of action and variable therapeutic index. Activation of several G protein-coupled receptors (GPCRs), for example, GPR40, GPR119, GRP120, and GPR30 has been demonstrated to produce favorable effects on glucose homeostasis, food intake, body weight gain and possibly also β-cell preservation. Free fatty acids (FFAs) appear to stimulate insulin secretion through direct islet GPCR signaling and indirect stimulation of incretin secretion via receptor-mediated mechanisms. GPR40 and GPR119 are among the several receptors to play an important physiological role in insulin release. It is now known that both GPR40 and GPR119 are expressed in pancreatic β-cells and that activating these receptors stimulates insulin secretion in a glucose-dependent manner GPR120 is a receptor for unsaturated fatty acids, such as α-linoleic acid. Its expression has been found in both intestinal L cells and islets. Stimulation of GPR120 has been demonstrated to increase insulin levels and proliferation of β-cells. GPR30, a functional estrogen receptor, has been shown to be involved in glucose homeostasis and reduction of body weight in the DIO model in rodents. Compounds capable of activating these above-mentioned receptors could prove valuable agents for the treatment of type 2 diabetes and obesity. However, the ligands previously identified are generally low affinity agonists and may be of limited therapeutic use.

Pre-proglucagon is a 158 amino acid precursor polypeptide that is processed in different tissues to form a number of different proglucagon-derived peptides, including glucagon, glucagon-like peptide-1 (GLP-1), glucagon-like peptide-2 (GLP-2) and oxyntomodulin (OXM), that are involved in a wide variety of physiological functions, including glucose homeostasis, insulin secretion, gastric emptying, and intestinal growth, as well as the regulation of food intake. Glucagon is a 29-amino acid peptide that corresponds to amino acids 33 through 61 of pre-proglucagon, while GLP-1 is produced as a 37-amino acid peptide that corresponds to amino acids 72 through 108 of pre-proglucagon. GLP-1(7-36) amide or GLP-1(7-37) acid are biologically potent forms of GLP-1, that demonstrate essentially equivalent activity at the GLP-1 receptor.

Glucagon is used in the acute treatment of severe hypoglycemia. Oxyntomodulin has been reported to have pharmacological ability to suppress appetite and lower body weight. GLP-1 and GLP-1 receptor agonists are used as treatment for Type II diabetes. Exendin-4 is a peptide present in the saliva of the Gila monster that resembles GLP-1 in structure, and like glucagon and GLP-1, increases insulin release.

Gastric inhibitory polypeptide (GIP) is also known as a glucose-dependent insulinotropic peptide, and is a member of the secretin family of hormones. GIP is derived from a 153-amino acid proprotein encoded by the GIP gene and circulates as a biologically active 42-amino acid peptide. The GIP gene is expressed in the small intestine as well as the salivary glands and is a weak inhibitor of gastric acid secretion. In addition to its inhibitory effects in the stomach, in the presence of glucose, GIP enhances insulin release by pancreatic beta islet cells when administered in physiological doses. GIP is believed to function as an enteric factor that stimulates the release of pancreatic insulin and that may play a physiological role in maintaining glucose homeostasis.

Osteocalcin is a noncollagenous protein found in bone and dentin. It is secreted by osteoblasts and thought to play a role in mineralization and calcium ion homeostasis. Osteocalcin has also been reported to function as a hormone in the body, causing beta cells in the pancreas to release more insulin, and at the same time directing fat cells to release the hormone adiponectin, which increases sensitivity to insulin.

SUMMARY OF THE INVENTION

Provided herein are glucagon superfamily peptides conjugated to G protein-coupled receptor ligands ("GPCR ligands"), preferably GPCR ligands involved in metabolism, including lipid metabolism or glucose homeostasis. These conjugates with plural activities are useful for the treatment of a variety of diseases.

The glucagon superfamily peptide conjugates of the invention can be represented by the following formula:

Q-L-Y wherein Q is a glucagon superfamily peptide, Y is a GPCR ligand, and L is a linking group or a bond.

The glucagon superfamily peptide (Q) in some embodiments can be a glucagon related peptide that exhibits agonist activity at the glucagon receptor, agonist activity at the GLP-1 receptor, agonist activity at the GIP receptor, co-agonist activity at the glucagon and GLP-1 receptors, co-agonist activity at the glucagon and GIP receptors, co-agonist activity at the GLP-1 and GIP receptors, or tri-agonist activity at the glucagon, GIP, and GLP-1 receptors. In some embodiments, the glucagon related peptide exhibits antagonist activity at the glucagon, GLP-1 or GIP receptor. The activity of the glucagon related peptide at the glucagon receptor, at the GLP-1 receptor, or at the GIP receptor can be in accordance with any of the teachings set forth herein. In some specific embodiments, the glucagon related peptide exhibits at least 0.1% activity of native glucagon at the glucagon receptor, at least 0.1% activity of native GLP-1 at the GLP-1 receptor, or at least 0.1% activity of native GIP at the GIP receptor.

The GPCR ligand (Y) is wholly or partly non-peptidic and acts at a G protein-coupled receptor with an activity in accordance with any of the teachings set forth herein. In some embodiments the GPCR ligand has an $EC_{50}$ or $IC_{50}$ of about 1 mM or less, or 100 μM or less, or 10 μM or less, or 1 μM or less. In some embodiments, the GPCR ligand has a molecular weight of up to about 5000 daltons, or up to about 2000 daltons, or up to about 1000 daltons, or up to about 500 daltons. The GPCR ligand may act at any of the G protein-coupled receptors described herein or have any of the structures described herein. In preferred embodiments, the GPCR is involved in metabolism, including lipid metabolism and glucose homeostasis. In selected embodiments, the GPCR is a member of the rhodopsin-like family, e.g. GPR30, GPR40, GPR119 or GPR120.

In some embodiments, the glucagon related peptide has an $EC_{50}$ (or $IC_{50}$) at the glucagon receptor within about 100-fold, or within about 75-fold, or within about 50-fold, or within about 40-, 30-, 25-, 20-, 15-, 10- or 5-fold of the $EC_{50}$ or $IC_{50}$ of the GPCR ligand at its G protein-coupled receptor. In some embodiments, the glucagon related peptide has an $EC_{50}$ (or $IC_{50}$) at the GLP-1 receptor within about 100-fold, or within about 75-fold, or within about 50-fold, or within about 40-, 30-, 25-, 20-, 15-, 10- or 5-fold of the $EC_{50}$ or $IC_{50}$ of the GPCR ligand at its G protein-coupled receptor. In some embodiments, the glucagon related peptide has an $EC_{50}$ (or $IC_{50}$) at the GIP receptor within about 100-fold, or within about 75-fold, or within about 50-fold, or within about 40-, 30-, 25-, 20-, 15-, 10- or 5-fold of the $EC_{50}$ or $IC_{50}$ of the GPCR ligand at its G protein-coupled receptor.

In some aspects of the invention, prodrugs of Q-L-Y are provided wherein the prodrug comprises a dipeptide prodrug element (A-B) covalently linked to an active site of Q via an amide linkage. Subsequent removal of the dipeptide under physiological conditions and in the absence of enzymatic activity restores full activity to the Q-L-Y conjugate.

In some aspects of the invention, pharmaceutical compositions comprising the Q-L-Y conjugate and a pharmaceutically acceptable carrier are also provided.

In other aspects of the invention, methods are provided for administering a therapeutically effective amount of a Q-L-Y conjugate described herein for treating a disease or medical condition in a patient. In some embodiments, the disease or medical condition is selected from the group consisting of metabolic syndrome, diabetes, obesity, liver steatosis, and a neurodegenerative disease.

BRIEF DESCRIPTION OF THE DRAWING

FIG. 1 presents an alignment of the amino acid sequences of various glucagon superfamily peptides or relevant fragments thereof. The amino acid sequence presented are GHRH (SEQ ID NO: 1619), PHI (SEQ ID NO: 1622), VIP (SEQ ID NO: 1620), PACAP-27 (SEQ ID NO: 1621), Exendin-4 (SEQ ID NO: 1618), GLP-1 (SEQ ID NO: 1603), Glucagon (SEQ ID NO: 1601), Oxyntomodulin (SEQ ID NO: 1679), GIP (SEQ ID NO: 1607), GLP-2 (SEQ ID NO: 1680) and Secretin (SEQ ID NO: 1624). The alignment shows how amino acid positions of glucagon can correspond to amino acid positions in other glucagon superfamily peptides.

DETAILED DESCRIPTION OF THE INVENTION

Definitions

In describing and claiming the invention, the following terminology will be used in accordance with the definitions set forth below.

The term "about" as used herein means greater or lesser than the value or range of values stated by 10 percent, but is not intended to designate any value or range of values to only this broader definition. Each value or range of values preceded by the term "about" is also intended to encompass the embodiment of the stated absolute value or range of values.

As used herein, the term "pharmaceutically acceptable carrier" includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

As used herein the term "pharmaceutically acceptable salt" refers to salts of compounds that retain the biological activity of the parent compound, and which are not biologically or otherwise undesirable. Many of the compounds disclosed herein are capable of forming acid and/or base salts by virtue of the presence of amino and/or carboxyl groups or groups similar thereto.

Pharmaceutically acceptable base addition salts can be prepared from inorganic and organic bases. Salts derived from inorganic bases, include by way of example only, sodium, potassium, lithium, ammonium, calcium and magnesium salts. Salts derived from organic bases include, but are not limited to, salts of primary, secondary and tertiary amines. Pharmaceutically acceptable acid addition salts may be prepared from inorganic and organic acids. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like.

As used herein, the term "treating" includes prophylaxis of the specific disorder or condition, or alleviation of the symptoms associated with a specific disorder or condition and/or preventing or eliminating said symptoms. For example, as used herein the term "treating diabetes" will refer in general to altering glucose blood levels in the direction of normal levels and may include increasing or decreasing blood glucose levels depending on a given situation.

As used herein an "effective" amount or a "therapeutically effective amount" of a glucagon peptide refers to a nontoxic but sufficient amount of the peptide to provide the desired effect. For example one desired effect would be the prevention or treatment of hypoglycemia, as measured, for example, by an increase in blood glucose level. An alternative desired effect for the glucagon peptides of the present disclosure would include treating hyperglycemia, e.g., as measured by a change in blood glucose level closer to normal, or inducing weight loss/preventing weight gain, e.g., as measured by reduction in body weight, or preventing or reducing an increase in body weight, or normalizing body fat distribution. The amount that is "effective" will vary from subject to subject, depending on the age and general condition of the individual, mode of administration, and the like. Thus, it is not always possible to specify an exact "effective amount." However, an appropriate "effective" amount in any individual case may be determined by one of ordinary skill in the art using routine experimentation.

The term, "parenteral" means not through the alimentary canal but by some other route, e.g., subcutaneous, intramuscular, intraspinal, or intravenous.

As used herein the term "patient" without further designation is intended to encompass any warm blooded vertebrate domesticated animal (including for example, but not limited to livestock, horses, cats, dogs and other pets), mammals, and humans.

The term "isolated" as used herein means having been removed from its natural environment. In some embodiments, the analog is made through recombinant methods and the analog is isolated from the host cell.

The term "purified," as used herein relates to the isolation of a molecule or compound in a form that is substantially free of contaminants normally associated with the molecule or compound in a native or natural environment and means having been increased in purity as a result of being separated from other components of the original composition. The term "purified polypeptide" is used herein to describe a polypeptide which has been separated from other compounds including, but not limited to nucleic acid molecules, lipids and carbohydrates.

As used herein, the term "peptide" encompasses a sequence of 2 or more amino acids and typically less than 50 amino acids, wherein the amino acids are naturally occurring or coded or non-naturally occurring or non-coded amino acids. Non-naturally occurring amino acids refer to amino acids that do not naturally occur in vivo but which, nevertheless, can be incorporated into the peptide structures described herein. "Non-coded" as used herein refer to an amino acid that is not an L-isomer of any of the following 20 amino acids: Ala, Cys, Asp, Glu, Phe, Gly, His, Ile, Lys, Leu, Met, Asn, Pro, Gln, Arg, Ser, Thr, Val, Trp, Tyr.

As used herein, "partly non-peptidic" refers to a molecule wherein a portion or all of the molecule is a chemical compound or substituent that has biological activity and that does not comprises a sequence of amino acids.

As used herein, "non-peptidic" refers to a molecule has biological activity and that does not comprise a sequence of amino acids.

As used herein, the terms "polypeptide" and "protein" are terms that are used interchangeably to refer to a polymer of amino acids, without regard to the length of the polymer. Typically, polypeptides and proteins have a polymer length that is greater than that of "peptides." In some instances, a protein comprises more than one polypeptide chain covalently or noncovalently attached to each other.

Throughout the application, all references to a particular amino acid position by number (e.g., position 28) refer to the amino acid at that position in native glucagon (SEQ ID NO: 1601) or the corresponding amino acid position in any analogs thereof. For example, a reference herein to "position 28" would mean the corresponding position 27 for an analog of glucagon in which the first amino acid of SEQ ID NO: 1601 has been deleted. Similarly, a reference herein to "position 28" would mean the corresponding position 29 for a analog of glucagon in which one amino acid has been added before the N-terminus of SEQ ID NO: 1601.

As used herein an "amino acid modification" refers to (i) a substitution or replacement of an amino acid of the reference peptide (e.g. SEQ ID NOs: 1601, 1603, 1607) with a different amino acid (naturally-occurring or coded or non-coded or non-naturally-occurring amino acid), (ii) an addition of an amino acid (naturally-occurring or coded or non-coded or non-naturally-occurring amino acid) to the reference peptide (e.g. SEQ ID NOs: 1601, 1603, 1607) or (iii) a deletion of one or more amino acids from the reference peptide (e.g. SEQ ID NOs: 1601, 1603, 1607).

In some embodiments, the amino acid substitution or replacement is a conservative amino acid substitution, e.g., a conservative substitution of the amino acid at one or more of positions 1, 2, 5, 7, 8, 10, 11, 12, 13, 14, 16, 17, 18, 19, 20, 21, 24, 27, 28 or 29. As used herein, the term "conservative amino acid substitution" is the replacement of one amino acid with another amino acid having similar properties, e.g., size, charge, hydrophobicity, hydrophilicity, and/or aromaticity, and includes exchanges within one of the following five groups:

I. Small aliphatic, nonpolar or slightly polar residues:
Ala, Ser, Thr, Pro, Gly;
II. Polar, negative-charged residues and their amides and esters:
Asp, Asn, Glu, Gln, cysteic acid and homocysteic acid;
III. Polar, positive-charged residues:
His, Arg, Lys; Ornithine (Orn)
IV. Large, aliphatic, nonpolar residues:
Met, Leu, Ile, Val, Cys, Norleucine (Nle), homocysteine
V. Large, aromatic residues:
Phe, Tyr, Trp, acetyl phenylalanine In some embodiments, the amino acid substitution is not a conservative amino acid substitution, e.g., is a non-conservative amino acid substitution.

As used herein the term "amino acid" encompasses any molecule containing both amino and carboxyl functional groups, wherein the amino and carboxyl groups are attached to the same carbon (the alpha carbon). The alpha carbon optionally may have one or two further organic substituents. For the purposes of the present disclosure designation of an amino acid without specifying its stereochemistry is intended to encompass either the L or D form of the amino acid, or a racemic mixture. However, in the instance where an amino acid is designated by its three letter code and includes a superscript number (i.e., $Lys^{-1}$), such a designation is intended to specify the native L form of the amino acid, whereas the D form will be specified by inclusion of a lower case d before the three letter code and superscript number (i.e., $dLys^{-1}$).

As used herein the term "hydroxyl acid" refers to an amino acid that has been modified to replace the alpha carbon amino group with a hydroxyl group.

As used herein the term "charged amino acid" refers to an amino acid that comprises a side chain that has a negative charge (i.e., deprotonated) or positive charge (i.e., protonated) in aqueous solution at physiological pH. For example negative-charged amino acids include aspartic acid, glutamic acid, cysteic acid, homocysteic acid, and homoglutamic acid, whereas positive-charged amino acids include arginine, lysine and histidine. Charged amino acids include the charged amino acids among the 20 coded amino acids, as well as atypical or non-naturally occurring or non-coded amino acids.

As used herein the term "acidic amino acid" refers to an amino acid that comprises a second acidic moiety (other than the alpha carboxylic acid of the amino acid), including for example, a side chain carboxylic acid or sulfonic acid group.

As used herein an "acylated" amino acid is an amino acid comprising an acyl group which is non-native to a naturally-occurring amino acid, regardless by the means by which it is produced. Exemplary methods of producing acylated amino acids and acylated peptides are known in the art and include acylating an amino acid before inclusion in the peptide or peptide synthesis followed by chemical acylation of the peptide. In some embodiments, the acyl group causes the peptide to have one or more of (i) a prolonged half-life in circulation, (ii) a delayed onset of action, (iii) an extended duration of action, (iv) an improved resistance to proteases, such as DPP-IV, and (v) increased potency at the glucagon superfamily peptide receptor.

As used herein, an "alkylated" amino acid is an amino acid comprising an alkyl group which is non-native to a naturally-occurring amino acid, regardless of the means by which it is produced. Exemplary methods of producing alkylated amino acids and alkylated peptides are known in the art and including alkylating an amino acid before inclusion in the peptide or peptide synthesis followed by chemical alkylation of the peptide. Without being held to any particular theory, it is believed that alkylation of peptides will achieve similar, if not the same, effects as acylation of the peptides, e.g., a prolonged half-life in circulation, a delayed onset of action, an extended duration of action, an improved resistance to proteases, such as DPP-IV, and increased potency at the glucagon superfamily peptide receptor.

The term "$C_1$-$C_n$ alkyl" wherein n can be from 1 through 18, as used herein, represents a branched or linear alkyl group having from one to the specified number of carbon atoms. For example, $C_1$-$C_6$ alkyl represents a branched or linear alkyl group having from 1 to 6 carbon atoms. Typical $C_1$-$C_{18}$ alkyl groups include, but are not limited to, methyl, ethyl, n-propyl, iso-propyl, butyl, iso-butyl, sec-butyl, tert-butyl, pentyl, hexyl and the like. Alkyl groups optionally can be substituted, for example, with hydroxy (OH), halo, aryl, carboxyl, thio, $C_3$-$C_8$ cycloalkyl, and amino.

The term "$C_0$-$C_n$ alkyl" wherein n can be from 1-18, as used herein, represents a branched or linear alkyl group having up to 18 carbon atoms. For example, the term "($C_0$-$C_6$ alkyl)OH" represents a hydroxyl parent moiety attached to an alkyl substituent having up to 6 carbon atoms (e.g. —OH, —$CH_2OH$, —$C_2H_4OH$, —$C_3H_6OH$, —$C_4H_8OH$, —$C_5H_{10}OH$, —$C_6H_{12}OH$).

The term "$C_3$-$C_n$ cycloalkyl" wherein n can be from 1 through 10, as used herein, represents a cyclic alkyl group having from one to the specified number of carbon atoms. For example, $C_3$-$C_8$ cycloalkyl represents a cyclic alkyl group having from 3 to 8 carbon atoms. Typical $C_3$-$C_{10}$ cyclo alkyl groups include, but are not limited to, cyclopropyl, cyclobutyl, cyclopentyl, cyclohexyl and the like. Cycloalkyl groups optionally can be substituted, for example, with hydroxy (OH), halo, aryl, carboxyl, thio, and amino.

The term "$C_2$-$C_n$ enyl" wherein n can be from 2 through 18, as used herein, represents an unsaturated branched or linear group having from 2 to the specified number of carbon atoms and at least one double bond. Examples of such groups include, but are not limited to, 1-propenyl, 2-propenyl (—$CH_2$—CH═$CH_2$), 1,3-butadienyl, (—CH═CHCH═$CH_2$), 1-butenyl (—CH═$CHCH_2CH_3$), hexenyl, pentenyl, and the like. Alkenyl groups optionally can be substituted, for example, with hydroxy (OH), halo, aryl, carboxyl, thio, $C_3$-$C_8$ cycloalkyl, and amino.

The term "$C_2$-$C_n$ ynyl" wherein n can be from 2 to 18, refers to an unsaturated branched or linear group having from 2 to n carbon atoms and at least one triple bond. Examples of such groups include, but are not limited to, 1-propynyl, 2-propynyl, 1-butynyl, 2-butynyl, 1-pentynyl, and the like. Alkynyl groups optionally can be substituted, for example, with hydroxy (OH), halo, aryl, carboxyl, thio, $C_3$-$C_8$ cycloalkyl, and amino.

As used herein the term "aryl" refers to a monocyclic or polycyclic (for example, bicyclic, tricyclic, or tetracyclic) aromatic groups. The size of the aryl ring or rings is indicated by designating the number of carbons present. For example, the term "($C_1$-$C_3$ alkyl)($C_6$-$C_{10}$ aryl)" refers to a 6 to 10 membered aryl that is attached to a parent moiety via a one to three membered alkyl chain. Unless otherwise indicated, an aryl group can be unsubstituted or substituted with one or more, and in particular one to five groups independently selected from, for example, halo, alkyl, alkenyl, $OCF_3$, $NO_2$, CN, NC, OH, alkoxy, amino, $CO_2H$, $C_3$-$C_8$ cycloalkyl, C(O)Oalkyl, aryl, and heteroaryl. Exemplary aryl groups include, but are not limited to, phenyl, naphthyl, tetrahydronaphthyl, chlorophenyl, indanyl, indenyl, methylphenyl, methoxyphenyl, trifluoromethylphenyl, nitrophenyl, 2,4-methoxychlorophenyl, and the like.

As used herein, the term "heteroaryl" refers to a monocyclic or polycyclic ring system containing one or more aromatic rings and containing at least one nitrogen, oxygen, or sulfur atom in an aromatic ring. The size of the heteroaryl ring and the presence of substituents or linking groups are indicated by designating the number of carbons present. For example, the term "($C_1$-$C_6$ alkyl)($C_5$-$C_6$ heteroaryl)" refers to a 5 or 6 membered heteroaryl that is attached to a parent moiety via a one to 6 membered alkyl chain. Unless otherwise indicated, a heteroaryl group can be unsubstituted or substituted with one or more, and in particular one to five groups independently selected from, for example, halo, alkyl, alkenyl, $OCF_3$, $NO_2$, CN, NC, OH, alkoxy, amino, $CO_2H$, $C_3$-$C_8$ cycloalkyl, C(O)Oalkyl, aryl, and heteroaryl. Examples of heteroaryl groups include, but are not limited to, thienyl, furyl, pyridyl, oxazolyl, quinolyl, thiophenyl, isoquinolyl, indolyl, triazinyl, triazolyl, isothiazolyl, isoxazolyl, imidazolyl, benzothiazolyl, pyrazinyl, pyrimidinyl, thiazolyl, and thiadiazolyl.

As used herein, the term "heteroalkyl" refers to a linear or branched hydrocarbon containing the indicated number of carbon atoms and at least one heteroatom in the backbone of the structure. Suitable heteroatoms for purposes herein include but are not limited to N, S, and O. Heteroalkyl groups optionally can be substituted, for example, with hydroxy (OH), halo, aryl, carboxyl, and amino As used herein, the term "heterocycloalkyl" refers to a cyclic hydrocarbon containing the indicated number of carbon atoms and at least one heteroatom in the backbone of the structure. Suitable heteroatoms for purposes herein include but are not limited to N, S, and O. Heterocycloalkyl groups optionally can be substituted, for example, with hydroxy (OH), halo, aryl, carboxyl, and amino As used herein, the term "halogen" or "halo" refers to one or more members of the group consisting of fluorine, chlorine, bromine, and iodine.

As used herein, the term "glucagon related peptide" refers to those peptides which have biological activity (as agonists or antagonists) at any one or more of the glucagon, GLP-1, GLP-2, and GIP receptors and comprise an amino acid sequence that shares at least 40% sequence identity (e.g., 45%, 50%, 55%, 60%, 65%, 70%, 75%, 80%, 85%, 90%, 95%) with at least one of native glucagon, native oxyntomodulin, native exendin-4, native GLP-1, native GLP-2, or native GIP. Unless otherwise stated, any reference to an amino acid position in a glucagon related peptide (e.g. for linkage of a GPCR ligand, a conjugate moiety, a hydrophilic polymer, acylation or alkylation) refers to the corresponding position relative to the native glucagon amino acid sequence (SEQ ID NO: 1601).

As used herein, the term "selectivity" of a molecule for a first receptor relative to a second receptor refers to the following ratio: $EC_{50}$ of the molecule at the second receptor divided by the $EC_{50}$ of the molecule at the first receptor. For example, a molecule that has an $EC_{50}$ of 1 nM at a first receptor and an $EC_{50}$ of 100 nM at a second receptor has 100-fold selectivity for the first receptor relative to the second receptor.

The term "identity" as used herein relates to the similarity between two or more sequences. Identity is measured by dividing the number of identical residues by the total number of residues and multiplying the product by 100 to achieve a percentage. Thus, two copies of exactly the same sequence have 100% identity, whereas two sequences that have amino acid deletions, additions, or substitutions relative to one another have a lower degree of identity. Those skilled in the art will recognize that several computer programs, such as those that employ algorithms such as BLAST (Basic Local Alignment Search Tool, Altschul et al. (1993) *J. Mol. Biol.* 215:403-410) are available for determining sequence identity As used herein, the term "glucagon superfamily peptide" refers to a group of peptides related in structure in their N-terminal and C-terminal regions (see, for example, Sherwood et al., *Endocrine Reviews* 21: 619-670 (2000)). Members of this group include all glucagon related peptides, as well as Growth Hormone Releasing Hormone (GHRH; SEQ ID NO: 1619), vasoactive intestinal peptide (VIP; SEQ ID NO: 1620), pituitary adenylate cyclase-activating polypeptide 27 (PACAP-27; SEQ ID NO: 1621), peptide histidine isoleucine (PHI; SEQ ID NO: 1642), peptide histidine methionine (PHM; SEQ ID NO: 1622), Secretin (SEQ ID NO: 1623), and analogs, derivatives or conjugates with up to 1, 2, 3, 4, 5, 6, 7, 8, 9 or 10 amino acid modifications relative to the native peptide. Such peptides preferably retain the ability to interact (agonist or antagonist) with receptors of the glucagon receptor superfamily. Unless otherwise stated, any reference to an amino acid position in a glucagon superfamily peptide (e.g. for linkage of a GPCR ligand, a conjugate moiety, a hydrophilic polymer, acylation or alkylation) refers to the corresponding position relative to the native glucagon amino acid sequence (SEQ ID NO: 1601), see FIG. 1 for an alignment of representative glucagon superfamily peptides.

The term "glucagon agonist peptide" refers to a compound that binds to and activates downstream signaling of the glucagon receptor. However, this term should not be construed as limiting the compound to having activity at only the glucagon receptor. Rather, the glucagon agonist peptides of the present disclosures may exhibit additional activities at other receptors, as further discussed herein. Glucagon agonist peptides, for example, may exhibit activity (e.g., agonist activity) at the GLP-1 receptor and/or the GIP receptor. Also, the term "glucagon agonist peptide" should not be construed as limiting the compound to only peptides. Rather, compounds other than peptides are encompassed by this term. Accordingly, the glucagon agonist peptide in some aspects is a peptide in conjugate form (a heterodimer, a multimer, a fusion peptide), a chemically-derivatized peptide, a pharmaceutical salt of a peptide, a peptidomimetic, and the like.

The term "GLP-1 agonist peptide" refers to a compound that binds to and activates downstream signaling of the GLP-1 receptor. However, this term should not be construed as limiting the compound to having activity at only the GLP-1 receptor. Rather, the GLP-1 agonist peptides of the present disclosures may exhibit additional activities at other receptors, as further discussed herein. GLP-1 agonist peptides, for example, may exhibit activity (e.g., agonist activity) at the glucagon receptor and/or the GIP receptor. Also, the term "GLP-1 agonist peptide" should not be construed as limiting the compound to only peptides. Rather, compounds other than peptides are encompassed by this term. Accordingly, the GLP-1 agonist peptide in some aspects is a peptide in conjugate form (a heterodimer, a multimer, a fusion peptide), a chemically-derivatized peptide, a pharmaceutical salt of a peptide, a peptidomimetic, and the like.

The term "GIP agonist peptide" refers to a compound that binds to and activates downstream signaling of the GIP receptor. However, this term should not be construed as limiting the compound to having activity at only the GIP receptor. Rather, the GIP agonist peptides of the present disclosures may exhibit additional activities at other receptors, as further discussed herein. GIP agonist peptides, for example, may exhibit activity (e.g., agonist activity) at the GLP-1 receptor. Also, the term "GIP agonist peptide" should not be construed as limiting the compound to only peptides. Rather, compounds other than peptides are encompassed by this term. Accordingly, the GIP agonist peptide in some aspects is a peptide in conjugate form (a heterodimer, a multimer, a fusion peptide), a chemically-derivatized peptide, a pharmaceutical salt of a peptide, a peptidomimetic, and the like.

The term "glucagon antagonist peptide" refers to a compound that counteracts glucagon activity or prevents glucagon function. For example, a glucagon antagonist exhibits at least 60% inhibition (e.g., at least 70%, 80%, 90% or more inhibition) of the maximum response achieved by glucagon at the glucagon receptor. In a specific embodiment, the glucagon antagonist at a concentration of about 1 µM exhibits less than about 20% of the maximum agonist activity achieved by glucagon at the glucagon receptor (e.g. less than about 10% or 5%). This term should not be construed as limiting the compound to having activity at only the glucagon receptor. Rather, the glucagon antagonist peptides of the present disclosures may exhibit additional activities at the glucagon receptor (e.g., partial agonism) or other receptor. Glucagon antagonist peptides, for example, may exhibit activity (e.g., agonist activity) at the GLP-1 receptor. Also, the term "glucagon antagonist peptide" should not be construed as limiting the compound to only peptides. Rather, compounds other than peptides are encompassed by these terms. Accordingly, in some aspects, the glucagon agonist peptide is a peptide in conjugate form, a chemically-derivatized peptide, a pharmaceutical salt of a peptide, a peptidomimetic, and the like.

The term "GLP-1 antagonist peptide" refers to a compound that counteracts GLP-1 activity or prevents GLP-1 function. For example, a GLP-1 antagonist exhibits at least 60% inhibition (e.g., at least 70%, 80%, 90% or more inhibition) of the maximum response achieved by GLP-1 at the GLP-1 receptor. In a specific embodiment, a GLP-1 antagonist at a concentration of about 1 µM exhibits less than about 20% of the maximum agonist activity achieved by GLP-1 at the GLP-1 receptor (e.g. less than about 10% or 5%). The term should not be construed as limiting the compound to having activity at only the GLP-1 receptor. Rather, the GLP-1 antagonist peptides of the present disclosures may exhibit additional activities at the GLP-1 receptor (e.g., partial agonism) or other receptor. GLP-1 antagonist peptides, for example, may exhibit activity (e.g., agonist activity) at the glucagon receptor. Also, the term "GLP-1 antagonist peptide" should not be construed as limiting the compound to only peptides. Rather, compounds other than peptides are encompassed by these terms. Accordingly, in some aspects, the GLP-1 agonist peptide is a peptide in conjugate form, a chemically-derivatized peptide, a pharmaceutical salt of a peptide, a peptidomimetic, and the like.

The term "GIP antagonist peptide" refers to a compound that counteracts GIP activity or prevents GIP-1 function. For example, a GIP antagonist exhibits at least 60% inhibition (e.g., at least 70%, 80%, 90% or more inhibition) of the maximum response achieved by GIP at the GIP receptor. In a specific embodiment, a GIP antagonist at a concentration of about 1 µM exhibits less than about 20% of the maximum agonist activity achieved by GIP at the GIP receptor (e.g. less than about 10% or 5%). The term should not be construed as limiting the compound to having activity at only the GIP receptor. Rather, the GIP antagonist peptides of the present disclosures may exhibit additional activities at the GIP receptor (e.g., partial agonism) or other receptor. GIP antagonist peptides, for example, may exhibit activity (e.g., agonist activity) at the glucagon receptor. Also, the term "GIP antagonist peptide" should not be construed as limiting the compound to only peptides. Rather, compounds other than peptides are encompassed by these terms. Accordingly, in some aspects, the GIP agonist peptide is a peptide in conjugate form, a chemically-derivatized peptide, a pharmaceutical salt of a peptide, a peptidomimetic, and the like.

As used herein, the terms "glucagon analog" and "glucagon peptide" can be used interchangeably to refer to an analog of glucagon that has the indicated activity at a glucagon related peptide receptor.

As used herein the term "native glucagon" refers to a peptide consisting of the sequence of SEQ ID NO: 1601.

As used herein, the term "native GLP-1" is a generic term that designates GLP-1(7-36) amide (SEQ ID NO: 1603), GLP-1(7-37) acid (SEQ ID NO: 1604) or a mixture of those two compounds.

As used herein, the term "native GIP" refers to a peptide consisting of SEQ ID NO: 1607.

As used herein, "glucagon potency" or "potency compared to native glucagon" of a molecule refers to the ratio of the $EC_{50}$ of the molecule at the glucagon receptor divided by the $EC_{50}$ of native glucagon at glucagon receptor.

As used herein, "GLP-1 potency" or "potency compared to native GLP-1" of a molecule refers to the ratio of the $EC_{50}$ of the molecule at GLP-1 receptor divided by the $EC_{50}$ of native GLP-1 at GLP-1 receptor.

As used herein, "GIP potency" or "potency compared to native GIP" of a molecule refers to the ratio of the $EC_{50}$ of the molecule at the GIP receptor divided by the $EC_{50}$ of native GIP at the GIP receptor.

As used herein, "GPCR ligand" refers to a hydrophobic or lipophilic moiety that has biological activity (either agonist or antagonist) at a G protein-coupled receptor (GPCR). The GPCR ligand is wholly or partly non-peptidic. In some embodiments, the GPCR ligand is an agonist that binds to and activates the GPCR. In other embodiments, the GPCR ligand is an antagonist. In some embodiments, the GPCR ligand is an antagonist that acts by wholly or partially blocking binding of native ligand to the active site. In other embodiments, the GPCR ligand is an antagonist that acts by binding to the active site or an allosteric site and preventing activation of, or de-activating, the GPCR.

As used herein, "steroids and derivatives thereof" refers to compounds, either naturally occurring or synthesized, having a structure of Formula A:

Formula A

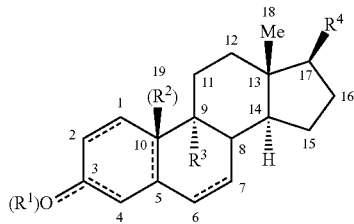

wherein $R^1$ and $R^2$, when present, are independently moieties that permit or promote agonist or antagonist activity upon binding of the compound of Formula A to a GPCR; $R^3$ and $R^4$ are independently moieties that permit or promote agonist or antagonist activity upon binding of the compound of Formula A to a GPCR; and each dashed line represents an optional double bond. Formula A may further comprise one or more substituents at one or more of positions 1, 2, 3, 4, 5, 6, 7, 8, 9, 11, 12, 14, 15, 16, and 17 Contemplated optional substituents include, but are not limited to, OH, $NH_2$, ketone, and $C_1$-$C_{18}$ alkyl groups. Specific, nonlimiting examples of steroids and derivatives thereof include cholesterol, cholic acid estradiol, testosterone, and hydrocortisone.

As used herein, "fatty acids and derivatives thereof" refers to carboxylic acids comprising a unbranched $C_1$ to $C_{28}$ alkyl or $C_2$ to $C_{28}$ alkenyl moiety and can optionally comprise one or more halo substituents and/or optionally comprise one or more substituents other than halo. In some embodiments, the unbranched alkyl or alkenyl moiety can be wholly halo substituted (e.g., all hydrogens replaced with halo atoms). A short chain fatty acid comprises 1-5 carbon atoms. A medium chain fatty acid comprises 6-12 carbon. A long chain fatty acid comprises 13-22 carbon atoms. A very long chain fatty acid comprises 23-28 carbon atoms. Specific, nonlimiting examples of fatty acids include formic acid, acetic acid, n-caproic acid, heptanoic acid, caprylic acid, nonanoic acid, capric acid, undecanoic acid, lauric acid, tridecanoic acid, myristic acid, pentadeconoic acid, palmitic acid, heptadecanoic acid, stearic acid, nonadecanoic acid, arachidic acid, heneicosanoic acid, behenic acid, tricosanoic acid, mead acid, myristoleic acid, palmitoleic acid, sapienic acid, oleic acid, linoleic acid, α-linolenic acid, elaidic acid, petroselinic acid, arachidonic acid, dihydroxyeicosatetraenoic acid (Di-HETE), octadecynoic acid, eicosatriynoic acid, eicosadienoic acid, eicosatrienoic acid, eicosapentaenoic acid, erucic acid, dihomolinolenic acid, docosatrienoic acid, docosapentaenoic acid, docosahexaenoic acid, and adrenic acid.

As used herein, "free fatty amides and derivatives thereof" refers to structures of Formula C:

Formula C

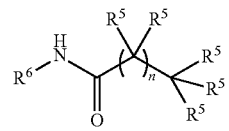

wherein n is 0-26 and each $R^5$, when present, is independently a moiety that permits or promotes agonist or antagonist activity upon binding of the compound of Formula C to a GPCR. For example, each $R^5$, when present, can independently be hydrogen, $C_1$-$C_7$ alkyl, or halogen; and $R^6$ can be hydrogen, $C_1$-$C_{18}$ alkyl, ($C_1$-$C_{18}$ alkyl)OH, ($C_1$-$C_{18}$ alkyl)$NH_2$, ($C_0$-$C_8$ alkyl)halo, $C_2$-$C_{18}$ alkenyl, $C_2$-$C_{18}$ alkynyl, heteroalkyl, ($C_0$-$C_8$ alkyl)aryl, or ($C_0$-$C_8$ alkyl)heteroaryl. Nonlimiting examples of free fatty amides include oleamide, stearoylethanolamide, palmitoylethanolamide, linolenoyl ethanolamide, linoleoyl ethanolamide, anandamide, oleoylehtanolamide, and N-oleoyldopamine.

As used herein, "phospholipids and derivatives thereof" refers to saturated or unsaturated compounds of Formula D:

Formula D

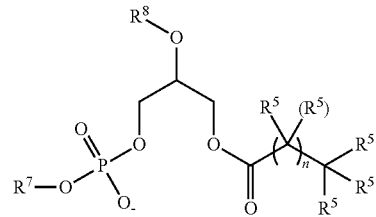

wherein n is 0-26, each $R^5$, when present, $R^7$, and $R^8$ are moieties that permit or promote agonist or antagonist activity upon binding of the compound of Formula D to a GPCR. For example, each $R^5$, when present, can independently be hydrogen, $C_1$-$C_7$ alkyl or halogen; $R^7$ can be choline, ethanolamine, or inositol; and $R^8$ can be hydrogen or

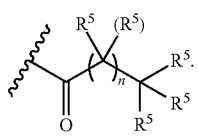

Nonlimiting examples of phospholipids and derivatives thereof include platelet activating factor, lyso-platelet activating factor, oleo lysophosphatidylcholine, stearoyl lysophosphatidylcholine, palmitoyl lysophosphatidylcholine, lysophosphatidylethanolamine, and lysophosphatidylinositol.

As used herein, "grifolic acid and derivatives thereof" refers to compounds of Formula E:

Formula E

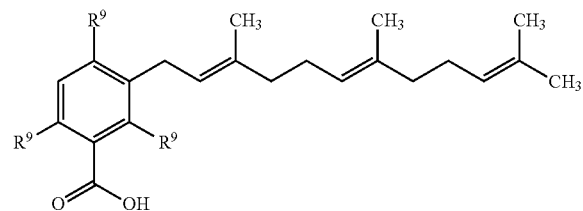

wherein each $R^9$ is independently a functional group that permits or promotes agonist or antagonist activity upon binding of the compound of Formula E to a GPCR. For example, each $R^9$ can independently be hydrogen, OH, or $O(C_1-C_8$ alkyl).

As used herein, "diacetylphloroglucinol and derivatives thereof" refers to compounds of Formula F:

Formula F

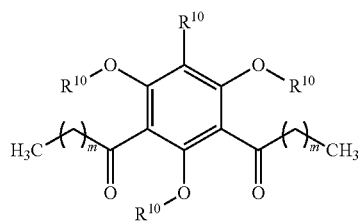

wherein each m is independently 0-15, and each $R^{10}$ is independently a functional group that permits or promotes agonist or antagonist activity upon binding of the compound of Formula F to a GPCR. For example, each $R^{10}$ can independently be hydrogen or $C_1-C_{18}$ alkyl.

As used herein, "retinoic acid and derivatives thereof" refers to compounds of Formula G:

Formula G

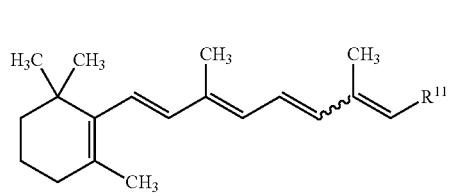

wherein $R^{11}$ is a functional group that permits or promotes agonist or antagonist activity upon the binding of the compound of Formula G to a GPCR, and  represents either E or Z stereochemistry. For example, $R^{11}$ can be C(O)OH, $CH_2OH$, or C(O)H. Nonlimiting examples of retinoic acid and derivatives thereof include all-trans-retinoic acid, retinol, retinal, and 11-cis-retinoic acid.

As used herein, "thiazolidinedione derivative" refers to molecules comprising a functional group represented by Formula H:

Formula H

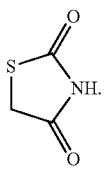

Nonlimiting examples of thiazolidinedione derivatives include rosiglitazone, pioglitazone, and troglitazone.

As used herein, "linking group" is a molecule or group of molecules that binds two separate entities to one another. Linking groups may provide for optimal spacing of the two entities or may further supply a labile linkage that allows the two entities to be separated from each other. Labile linkages include hydrolyzable groups, photocleavable groups, acid-labile moieties, base-labile moieties and enzyme cleavable groups.

As used herein, the term "prodrug" is defined as any compound that undergoes chemical modification before exhibiting its full pharmacological effects.

As used herein, a "dipeptide" is the result of the linkage of an α-amino acid or α-hydroxyl acid to another amino acid, through a peptide bond.

As used herein the term "chemical cleavage" absent any further designation encompasses a non-enzymatic reaction that results in the breakage of a covalent chemical bond.

Embodiments

The present disclosures provide glucagon superfamily peptides conjugated with GPCR ligands. In some aspects, the GPCR ligands are capable of acting at G protein-coupled receptors involved in metabolism or glucose homeostasis, and the conjugate provides superior biological effects on metabolism or glucose homeostasis compared to the peptide alone or the GPCR ligand alone. Without being bound by a theory of the invention, the GPCR ligand may serve to target the glucagon superfamily peptide to particular types of cells or tissues; or alternatively the glucagon superfamily peptide may serve to target the GPCR ligand or enhance its transport into the cell, e.g. through binding of peptide to a receptor that internalizes the conjugate.

The glucagon superfamily peptide conjugates of the invention can be represented by the following formula:

Q-L-Y wherein Q is a glucagon superfamily peptide, Y is a GPCR ligand, and L is a linking group or a bond.

The glucagon superfamily peptide (Q) in some embodiments can be a glucagon related peptide that exhibits agonist activity at the glucagon receptor, agonist activity at the GLP-1 receptor, agonist activity at the GIP receptor, co-agonist activity at the glucagon and GLP-1 receptors, co-agonist activity at the glucagon and GIP receptors, co-agonist activity at the GLP-1 and GIP receptors, or tri-agonist activity at the glucagon, GIP, and GLP-1 receptors. In some embodiments, the glucagon related peptide exhibits antagonist activity at the glucagon, GLP-1 or GIP receptor.

The glucagon superfamily peptide (Q) in some embodiments may be a glucagon-related peptide, Growth Hormone Releasing Hormone (GHRH; SEQ ID NO: 1619), vasoactive intestinal peptide (VIP; SEQ ID NO: 1620), Pituitary adenylate cyclase-activating polypeptide 27 (PACAP-27; SEQ ID NO: 1621), peptide histidine methionine (PHM; SEQ ID NO: 1622), or Secretin (SEQ ID NO: 1623), and/or and analogs, derivatives and conjugates thereof. Glucagon superfamily peptides may have common structural characteristics, including but not limited to homology within the N-terminal amino acids and/or alpha-helical structure within the C-terminal portion. It is believed that the C-terminus generally functions in receptor binding and the N-terminus generally functions in receptor signaling. A few amino acids in the N-terminal portion and C-terminal portion are highly conserved among members of the glucagon superfamily, for example, His1, Gly4, Phe6, Phe22, Val23, Trp25, and Leu26, with amino acids at these positions showing identity, conservative substitutions or similarity in amino acid side chains. In some embodiments the glucagon related peptide Q is glucagon (SEQ ID NO: 1601), oxyntomodulin (SEQ ID NO: 1606), exendin-4 (SEQ ID NO: 1618), Glucagon-like peptide-1 (GLP-1) (amino acids 7-37 provided as SEQ ID NOs: 1603 and 1604), Glucagon-like peptide-2 (GLP-2) (SEQ ID NO: 1608), GIP (SEQ ID NO: 1607) or analogs, derivatives and conjugates of the foregoing. In some embodiments Q as a glucagon related peptide comprises an amino acid sequence that is at least about 40%, 45%, 50%, 55%, 60%, 65%, 70%, 75%, 80%, 85%, 90%, or 95% identical to the corresponding sequence of native glucagon, native oxyntomodulin, native exendin-4, native (7-37)GLP-1, native GLP-2, or native GIP over the length of the native peptide (or over the positions which correspond to glucagon, see e.g., FIG. 1). In other embodiments, a glucagon superfamily peptide (Q) comprises an amino acid sequence of native glucagon, native exendin-4, native (7-37)GLP-1, native GLP-2, native GHRH, native VIP, native PACAP-27, native PHM, native Oxyntomodulin, native Secretin, or native GIP with up to 1, 2, 3, 4, 5, 6, 7, 8, 9 or 10 amino acid modifications. In still further embodiments, Q comprises an amino acid sequence which is a chimera of two or more native glucagon related peptide sequences. In some embodiments, Q comprises an amino acid sequence at least about 50% identical to native glucagon (SEQ ID NO: 1601) that retains the alpha-helix conformation of the amino acids corresponding to amino acids 12-29.

In related aspects, the invention provides peptide conjugates represented by the formula

Q-L-Y wherein Q is osteocalcin, calcitonin, amylin, or an analog, derivative or conjugate thereof, rather than a glucagon superfamily peptide; Y is a GPCR ligand; and L is a linking group or a bond. In some embodiments, Q comprises osteocalcin (SEQ ID NO: 1644), or an amino acid sequence that is at least about 40%, 45%, 50%, 55%, 60%, 65%, 70%, 75%, 80%, 85%, 90%, or 95% identical to native osteocalcin over the length of the native peptide. Q may comprise an analog of osteocalcin with up to 1, 2, 3, 4, 5, 6, 7, 8, 9 or 10 amino acid modifications relative to native osteocalcin, or a truncated analog of osteocalcin (e g, amino acids 70-84) with up to 1, 2, 3, 4, 5, 6, 7, 8, 9 or 10 amino acid modifications relative to the native truncated osteocalcin. In some embodiments, Q comprises calcitonin (SEQ ID NO: 1645), or an amino acid sequence that is at least about 40%, 45%, 50%, 55%, 60%, 65%, 70%, 75%, 80%, 85%, 90%, or 95% identical to native calcitonin over the length of the native peptide. Q may comprise an analog of calcitonin with up to 1, 2, 3, 4, 5, 6, 7, 8, 9 or 10 amino acid modifications relative to native calcitonin. In some embodiments, Q comprises amylin (SEQ ID NO: 1646), or an amino acid sequence that is at least about 40%, 45%, 50%, 55%, 60%, 65%, 70%, 75%, 80%, 85%, 90%, or 95% identical to native amylin over the length of the native peptide. Q may comprise an analog of amylin with up to 1, 2, 3, 4, 5, 6, 7, 8, 9 or 10 amino acid modifications relative to native amylin.

The GPCR Ligand (Y)

In the present disclosures relating to Q-L-Y conjugates, Y is a ligand that acts at any G protein-coupled receptor (GPCR), including any one the "G protein-coupled receptor superfamily" (GPCR superfamily), or a class or subgroup thereof. The GPCR superfamily is composed of receptors typically sharing a common structural motif of seven transmembrane helical domains. GPCRs play a crucial role in receiving chemical signals from other cells and, in response, activating certain cellular responses such as, for example, cellular metabolism, cell growth and motility, inflammation, neuronal signaling, and blood coagulation.

GPCR ligands bind to the portion of the GPCR that is on the outside of a cell. Ligand binding to the GPCR causes a conformational change in the GPCR, allowing the GPCR to act as a guanine nucleotide exchange factor. The ligand-bound GPCR activates an associated G protein by exchanging its bound GDP for a GTP. As a result, the G protein's alpha-subunit, together with the bound GTP, dissociate from the beta and gamma subunits of the GPCR to initiate intracellular signaling proteins or to target functional proteins. G protein-coupled receptors are important as targets for molecules such as hormones, neurotransmitters and physiologically active substances, which control, regulate or adjust the functions of living bodies. For example, GPCRs include receptors for biogenic amines, e.g., dopamine, epinephrine, histamine, glutamate (metabotropic effect), acetylcholine (muscarinic effect), and serotonin; for lipid mediators of inflammation such as prostaglandins, platelet activating factor, and leukotrienes; for peptide hormones such as calcitonin, C5a anaphylatoxin, follicle stimulating hormone, gonadotropin releasing hormone, neurokinin, oxytocin, and for proteases such as thrombin, trypsin, and factor VIIa/Xa; and for sensory signal mediators, e.g., retinal photopigments and olfactory stimulatory molecules.

G protein-coupled receptors can be divided generally into six classes based on sequence homology and functional similarity: Class A (Rhodopsin-like), Class B (Secretin receptor family), Class C (Metabotropic glutamate/pheromone), Class D (Fungal mating pheromone receptors), Class E (Cyclic AMP receptors), and Class F (Frizzled/Smoothened).

Class A (Rhodopsin-like) GPCRs, for example, represent a protein family that includes hormone, neurotransmitter and light receptors, all of which transduce extracellular signals through interaction with guanine nucleotide-binding (G) proteins. Members of Class A receptors include: Melatonin receptor, Interleukin-8 receptor, Orexin receptor, Angiotensin II receptor, Chemokine receptor, Galanin receptor, Bradykinin receptor, Endothelin receptor, Histamine H2 receptor, Somatostatin receptor, Neuropeptide Y receptor, Urotensin II receptor, GPR orphan receptor, Olfactory receptor, Mas transmembrane protein, Formyl/methionyl peptide receptor, Histamine H1 receptor, Dopamine receptor, Muscarinic acetylcholine receptor, C—X—C chemokine receptor type 5, 5-Hydroxytryptamine 7 receptor, G10D orphan receptor, Prolactin-releasing peptide receptor, RDC1 orphan receptor, Opioid receptor, 5-Hydroxytryptamine 4 receptor, Bombesin receptor, Adenosine receptor, Gonadotrophin releasing hormone receptor, Melanocortin/ACTH receptor, Neurokinin receptor, Opsin, Retinal pigment epithelium GPCR, Vasopressin receptor, Octopamine receptor, Glycoprotein hormone receptor, P2Y5 purinoceptor, Cannabinoid receptor, 5-Hydroxytryptamine receptor, 5-Hydroxytryptamine 6 receptor, Adrenergic receptor, Anaphylatoxin chemotactic receptor, DEZ orphan receptor, GPR1 orphan receptor, GPR4 orphan receptor, Platelet-activating factor receptor, P2 purinoceptor, Peropsin, APJ receptor, Growth hormone secretagogue receptor type 1, GPR37 orphan receptor, Protease-activated receptor, Histamine H3 receptor, Leukotriene B4 receptor, Neurotensin receptor, Sphingosine 1-phosphate receptor, Lysophosphatidic acid receptor, Cysteinyl leukotriene receptor, CX3C Fractalkine chemokine receptor, G2A lysophosphatidylcholine receptor, OGR1 sphingosylphosphorylcholine receptor, Neuromedin U receptor, XCR1 Lymphotactin chemokine receptor, Neuropeptide FF receptor, Psychosine receptor, Histamine H4 receptor, KISS-1 peptide receptor, Relaxin receptor, Melanin-concentrating hormone receptor, Prostanoid receptor, Cholecystokinin receptor, Trace amine receptor, Thyrotropin-releasing hormone receptor, Neuropeptide W receptor, GPR40-related receptor, and G-protein-coupled receptor 30.

GPR30 is a member of the rhodopsin-like family of G protein-coupled receptors and has been demonstrated to be a functional estrogen receptor. Female GPR30$^{(-/-)}$ mice exhibit hyperglycemia and impaired glucose tolerance, reduced body growth, increased blood pressure, and reduced serum IGF-I levels, demonstrating the importance of this receptor to normal metabolic function. GPR30 is capable of binding 17β-estradiol (E2) in vitro with high affinity resulting in increases in cAMP production and intracellular [Ca$^{2+}$]. Thus, without wishing to be bound by any theory, it is believed that conjugates of the disclosure exhibiting GPR30 agonist activity are useful for treating hyperglycemic conditions, such as diabetes mellitus.

GPR40 is also a member of the rhodopsin-like family of GPCRs. It is highly expressed in pancreatic β-cells and is activated by medium- and long-chain saturated and unsaturated free fatty acids. In Chinese hamster ovary (CHO) cells, exogenously expressed GPR40 increased intracellular [Ca$^{2+}$] and activated extracellular signal-related kinase 1/2. In rat pancreatic β-cells, linolenic acid reduced voltage-gated K$^+$ current through GPR40-mediated cAMP levels and protein kinase A activity, leading to enhanced β-cell excitability and insulin secretion. Thus, without wishing to be bound by any theory, it is believed that conjugates of the disclosure exhibiting GPR40 agonist activity are useful for treating hyperglycemic conditions, such as diabetes mellitus.

In humans GPR119, also a member of the rhodopsin-like family, is highly expressed in pancreatic islet β-cells and fetal liver. Phospholipids and fatty acid amides have been described as possible endogenous ligands for GPR119. Transfection of cells with GPR119 show an increase in constitutive intracellular cAMP levels. When treated with platelet-activating factor and lyso-platelet activating factor, CHO cells expressing GPR119 exhibit increased cAMP levels. Without wishing to be bound by any theory, it is believed that conjugates of the disclosure exhibiting GPR119 agonist activity are useful for treating hyperglycemic conditions, such as diabetes mellitus.

GPR120, also member of the rhodopsin-like family, is highly expressed in the human intestinal tract and has been shown to be activated by medium- to long-chain free fatty acids, including α-linoleic acid. Stimulation of GPR120 has been demonstrated to increase insulin levels and proliferation of β-cells. Mouse enteroendocrine STC-1 cells secrete GLP-1 and cholecystokinin upon challenge with free fatty acids and this response can be inhibited by transfection with an RNAi expression vector specific for GPR120, indicating a role in metabolic homestasis. Without wishing to be bound by any theory, it is believed that conjugates of the disclosure exhibiting GPR120 agonist activity are useful for treating hyperglycemic conditions, such as diabetes mellitus.

Activity of the GPCR Ligand

In some embodiments, Y exhibits an EC$_{50}$ for GPCR activation (or in the case of an antagonist, an IC$_{50}$) of about 10 mM or less, or 1 mM (1000 µM) or less (e.g., about 750 µM or less, about 500 µM or less, about 250 µM or less, about 100 µM or less, about 75 µM or less, about 50 µM or less, about 25 µM or less, about 10 µM or less, about 7.5 µM or less, about 6 or less, about 5 µM or less, about 4 µM or less, about 3 µM or less, about 2 µM or less or about 1 µM or less). In some embodiments, Y exhibits an EC$_{50}$ or IC$_{50}$ at a GPCR of about 1000 nM or less (e.g., about 750 nM or less, about 500 nM or less, about 250 nM or less, about 100 nM or less, about 75 nM or less, about 50 nM or less, about 25 nM or less, about 10 nM or less, about 7.5 nM or less, about 6 nM or less, about 5 nM or less, about 4 nM or less, about 3 nM or less, about 2 nM or less or about 1 nM or less). In some embodiments, Y has an EC$_{50}$ or IC$_{50}$ at a GPCR which is in the picomolar range. Accordingly, in some embodiments, Y exhibits an EC$_{50}$ or IC$_{50}$ at a GPCR of about 1000 pM or less (e.g., about 750 pM or less, about 500 pM or less, about 250 pM or less, about 100 pM or less, about 75 pM or less, about 50 pM or less, about 25 pM or less, about 10 pM or less, about 7.5 pM or less, about 6 pM or less, about 5 pM or less, about 4 pM or less, about 3 pM or less, about 2 pM or less).

In some embodiments, Y exhibits an EC$_{50}$ or IC$_{50}$ at a GPCR that is about 0.1 pM or more, about 0.5 pM or more, or about 1 pM or more. G protein-coupled receptor activation (GPCR activity) can be measured in vitro by any method known in the art, including measurement of intracellular Ca$^{2+}$ concentration as described by Hara et al., *Naunyn-Schmied Arch Pharmacol* 380(3):247-55 (2009) or measurement of intracellular cAMP concentration as described by Overton et al., Cell Metabolism, 3, 165-175 (2006).

Briefly, to measure intracellular [Ca$^{2+}$]$_i$, cells expressing the GPCR of interest are seeded at a density of 2×10$^5$ cells/well on collagen-coated 96-well plates, incubated at 37° C. for 21 hours, and then incubated in Hanks' balanced salt solution (HBSS, pH 7.4) containing Calcium Assay Kit Component A (Molecular Devices, Sunnyvale, Calif.) for one hour at room temperature. Mobilization of [Ca$^{2+}$]$_i$ evoked by agonists is monitored using a fluorometric imaging plate reader.

To measure cAMP production, HEK293 cell monolayers expressing the GPCR of interest under the control of a tetracycline-inducible promoter are pretreated overnight with 10-20 ng/mL tetracycline to induce expression of the GPCR. Treated monolayers are then incubated for 30 minutes at 37° C. with a particular agonist in stimulation buffer plus 1% DMSO. Cells are then lysed and cyclic AMP content is determined by any method known in the art, e.g., with the Perkin Elmer AlphaScreen cAMP kit.

In some embodiments, including any of the preceeding embodiments, Y exhibits about 0.001% or more, about 0.01% or more, about 0.1% or more, about 0.5% or more, about 1% or more, about 5% or more, about 10% or more, about 20% or more, about 30% or more, about 40% or more, about 50% or more, about 60% or more, about 75% or more, about 100% or more, about 125% or more, about 150% or more, about 175% or more, about 200% or more, about 250% or more, about 300% or more, about 350% or more, about 400% or more, or about 450% or higher activity at the GPCR relative to the native ligand (GPCR potency). In some embodiments, Y exhibits about 100% or less or about 500% or less activity at the GPCR relative to native ligand. The activity of Y at a receptor relative to a native ligand of the receptor is calculated as the inverse ratio of $EC_{50}$s for Y versus the native ligand. In some embodiments, Y is the native ligand of the receptor.

In some embodiments, Y exhibits an $EC_{50}$ or $IC_{50}$ at a GPCR that is about that is about 0.1 pM or more, about 0.5 pM or more, or about 1 pM or more, and about 100% or less or about 500% or less activity at the GPCR relative to native ligand. In some embodiments, Y exhibits an $EC_{50}$ or $IC_{50}$ at a GPCR that is about that is about 0.1 pM or more and about 500% or less activity at the GPCR relative to native ligand.

Structure of the GPCR Ligand (Y)

The GPCR ligand of the invention (Y) is partly or wholly non-peptidic and is hydrophobic or lipophilic. In some embodiments, the GPCR ligand has a molecular weight that is about 5000 daltons or less, or about 4000 daltons or less, or about 3000 daltons or less, or about 2000 daltons or less, or about 1750 daltons or less, or about 1500 daltons or less, or about 1250 daltons or less, or about 1000 daltons or less, or about 750 daltons or less, or about 500 daltons or less, or about 250 daltons or less. The structure of Y can be in accordance with any of the teachings disclosed herein.

Y can exhibit any structure that enables it to act at any G protein-coupled receptor (GPCR), including any one of the "G protein-coupled receptor superfamily" (GPCR superfamily), or a class or subgroup thereof. In some embodiments, Y acts at a Class A GPCR. In these embodiments, Y can be, for example, an adrenergic receptor agonist, such as a β3 adrenergic receptor agonist, which acts to increase thermogenesis and resembles the effect of glucagon, or a nicotinic acetylcholine receptor agonist, such as an α7-nicotinic acetylcholine receptor agonist, which plays a role in decreasing obesity-induced inflammation and improved metabolic syndrome (see Wang et al., "Activation of the Cholinergic Antiinflammatory Pathway Ameliorates Obesity-Induced Inflammation and Insulin Resistance" *Endocrinology* 152(3): 836-845 (2011).

β3 adrenergic receptor agonists include amibegron (ethyl ([(7S)-7-([(2R)-2-(3-chlorophenyl)-2-hydroxyethyl]amino)-5,6,7,8-tetrahydronaphthalen-2-yl]oxy)acetate), solabegron (3'-[(2-{[(2R)-2-(3-chlorophenyl)-2-hydroxyethyl]amino}ethyl)amino]biphenyl-3-carboxylic acid), CL316,243 [Fu et al., (2008) "The effects of beta(3)-adrenoceptor agonist CL-316,243 on adiponectin, adiponectin receptors and tumor necrosis factor-alpha expressions in adipose tissues of obese diabetic KKAy mice." European journal of pharmacology 584 (1): 202-6], L-796,568 [Larsen et al., (2002) "Effect of a 28-d treatment with L-796568, a novel β3-adrenergic receptor agonist, on energy expenditure and body composition in obese men". The American Journal of Clinical Nutrition 76 (4): 780-8], and LY-368,842, Ro40-2148, (S)-6-(4-(2-((3-(9H-carbazol-4-yloxy)-2-hydroxypropyl)amino)-2-methylpropyl)phenoxy)-3-pyridinecarboxamide monohydrochloride, (S)-4-{2-[2-hydroxy-3-(4-hydroxyphenoxy)propylamino]ethyl}phenoxymethylcyclohexylphosphinic acid lithium salt, 4-{1-[2-(S)-hydroxy-3-(4-hydroxyphenoxy)-propylamino]cyclopentylmethyl)phenyl}-phosphonic acid lithium salt, (RR)-5-{2-[2-(3,4-dihydroxyphenyl)-2-hydroxyethylamino]propyl}-1,3-benzodioxole-2,2-dicarboxylate [Arch, (2002) "β₃-adrenoceptor agonists: potential, pitfalls and progress". Eur J Pharm 440:99-107], and analogs of any of the foregoing that retain the 133 adrenergic receptor agonist activity, including pharmaceutically acceptable salts of such compounds. All references are and β3 adrenergic receptor agonists disclosed therein are incorporated by reference in their entirety.

α7-nicotinic acetylcholine receptor agonists include (+)-N-(1-azabicyclo[2.2.2]oct-3-yl)benzo[b]furan-2-carboxamide, A-582941, AR-R17779 ((2S)-2'H-spiro[4-azabicyclo[2.2.2]octane-2,5'-[1,3]oxazolidin]-2'-one), TC-1698, TC-5619 (N-[(2S,3S)-2-(pyridin-3-ylmethyl)-1-azabicyclo[2.2.2]oct-3-yl]-1-benzofuran-2-carboxamide), GTS-21 (3-[(3E)-3-[(2,4-dimethoxyphenyl)methylidene]-5,6-dihydro-4H-pyridin-2-yl]pyridine), PHA-543,613 (N-[(3R)-1-azabicyclo[2.2.2]oct-3-yl]furo[2,3-c]pyridine-5-carboxamide), PNU-282,987 (N-[(3R)-1-azabicyclo[2.2.2]oct-3-yl]-4-chlorobenzamide), PHA-709829, SSR-180,711 ((4-bromophenyl) 1,4-diazabicyclo[3.2.2]nonane-4-carboxylate), tropisetron, WAY-317,538 (5-morpholin-4-yl-pentanoic acid (4-pyridin-3-yl-phenyl)-amide), anabaseine, choline and nicotine, and analogs of any of the foregoing that retain the α7-nicotinic acetylcholine receptor agonist activity, including pharmaceutically acceptable salts of such compounds.

In the embodiments described herein, Y is conjugated to L (e.g. when L is a linking group) or Q (e.g. when L is a bond) at any position of Y that is capable of reacting with Q or L. One skilled in the art could readily determine the position and means of conjugation in view of general knowledge and the disclosure provided herein.

In any of the embodiments described herein wherein Y comprises a tetracyclic skeleton having three 6-membered rings joined to one 5-membered ring or a variation thereof (e.g. a Y that acts at the vitamin D receptor), the carbon atoms of the skeleton are referred to by position number, as shown below:

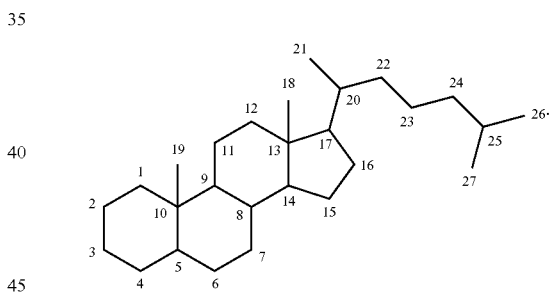

For example, a modification having a ketone at position-6 refers to the following structure:

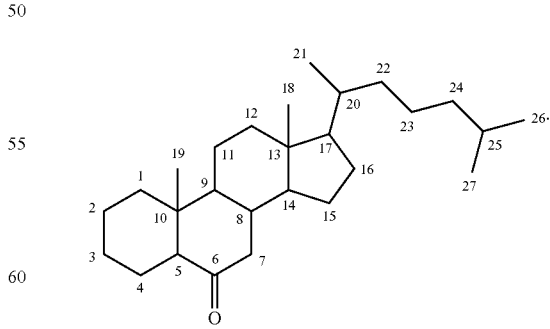

In some embodiments of the invention, Y acts at any GPCR. In these embodiments, Y can have any structure that permits or promotes agonist activity upon binding to a GPCR, while in other embodiments Y is an antagonist of a GPCR.

Steroid or Derivative Thereof

In some embodiments of the invention, Y is a steroid or derivative thereof. In exemplary embodiments, Y comprises a structure as shown in Formula A:

Formula A

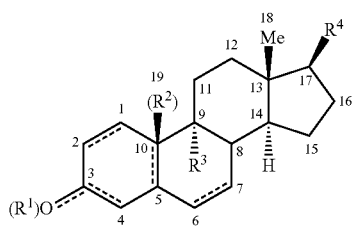

wherein $R^1$ and $R^2$, when present, are independently moieties that permit or promote agonist or antagonist activity upon binding of the compound of Formula A to a GPCR; $R^3$ and $R^4$ are independently moieties that permit or promote agonist or antagonist activity upon binding of the compound of Formula A to a GPCR; and each dashed line represents an optional double bond. Formula A may further comprise one or more substituents at one or more of positions 1, 2, 3, 4, 5, 6, 7, 8, 9, 11, 12, 14, 15, 16, and 17. Contemplated optional substituents include, but are not limited to, OH, $NH_2$, ketone, and $C_1$-$C_{18}$ alkyl groups.

In some embodiments, Y comprises a structure of Formula A wherein $R^1$ is present and is hydrogen, $C_1$-$C_{18}$ alkyl, $C_2$-$C_{18}$ alkenyl, $C_2$-$C_{18}$ alkynyl, heteroalkyl, $(C_0$-$C_8$ alkyl)aryl, $(C_0$-$C_8$ alkyl)heteroaryl, $(C_0$-$C_8$ alkyl)C(O)$C_1$-$C_{18}$ alkyl, $(C_0$-$C_8$ alkyl)C(O)$C_2$-$C_{18}$ alkenyl, $(C_0$-$C_8$ alkyl)C(O)$C_2$-$C_{18}$ alkynyl, $(C_0$-$C_8$ alkyl)C(O)H, $(C_0$-$C_8$ alkyl)C(O)aryl, $(C_0$-$C_8$ alkyl)C(O)heteroaryl, $(C_0$-$C_8$ alkyl)C(O)O$C_1$-$C_{18}$ alkyl, $(C_0$-$C_8$ alkyl)C(O)O$C_2$-$C_{18}$ alkenyl, $(C_0$-$C_8$ alkyl)C(O)O$C_2$-$C_{18}$ alkynyl, $(C_0$-$C_8$ alkyl)C(O)OH, $(C_0$-$C_8$ alkyl)C(O)O aryl, $(C_0$-$C_8$ alkyl)C(O)O heteroaryl, $(C_0$-$C_8$ alkyl)C(O)$NR^{24}C_1$-$C_{18}$ alkyl, $(C_0$-$C_8$ alkyl)C(O)$NR^{24}C_2$-$C_{18}$ alkenyl, $(C_0$-$C_8$ alkyl)C(O)$NR^{24}C_2$-$C_{18}$ alkynyl, $(C_0$-$C_8$ alkyl)C(O)$NR^{24}H_2$, $(C_0$-$C_8$ alkyl)C(O)$NR^{24}$aryl, $(C_0$-$C_8$ alkyl)C(O)$NR^{24}$heteroaryl, or $SO_3H$;

$R^2$ is present and is hydrogen, $(C_0$-$C_8$ alkyl)halo, $C_1$-$C_{18}$ alkyl, $C_2$-$C_{18}$ alkenyl, $C_2$-$C_{18}$ alkynyl, heteroalkyl, $(C_0$-$C_8$ alkyl)aryl, $(C_0$-$C_8$ alkyl)heteroaryl, $(C_0$-$C_8$ alkyl)O$C_1$-$C_{18}$ alkyl, $(C_0$-$C_8$ alkyl)O$C_2$-$C_{18}$ alkenyl, $(C_0$-$C_8$ alkyl)O$C_2$-$C_{18}$ alkynyl, $(C_0$-$C_8$ alkyl)OH, $(C_0$-$C_8$ alkyl)SH, $(C_0$-$C_8$alkyl)$NR^{24}C_1$-$C_{18}$ alkyl, $(C_0$-$C_8$ alkyl)$NR^{24}C_2$-$C_{18}$ alkenyl, $(C_0$-$C_8$ alkyl)$NR^{24}C_2$-$C_{18}$ alkynyl, $(C_0$-$C_8$ alkyl)$NR^{24}H_2$, $(C_0$-$C_8$ alkyl)C(O)$C_1$-$C_{18}$ alkyl, $(C_0$-$C_8$ alkyl)C(O)$C_2$-$C_{18}$ alkenyl, $(C_0$-$C_8$ alkyl)C(O)$C_2$-$C_{18}$ alkynyl, $(C_0$-$C_8$ alkyl)C(O)H, $(C_0$-$C_8$ alkyl)C(O)aryl, $(C_0$-$C_8$ alkyl)C(O)heteroaryl, $(C_0$-$C_8$ alkyl)C(O)O$C_1$-$C_{18}$ alkyl, $(C_0$-$C_8$ alkyl)C(O)O$C_2$-$C_{18}$ alkenyl, $(C_0$-$C_8$ alkyl)C(O)O$C_2$-$C_{18}$ alkynyl, $(C_0$-$C_8$ alkyl)C(O)OH, $(C_0$-$C_8$ alkyl)C(O)O aryl, $(C_0$-$C_8$ alkyl)C(O)O heteroaryl, $(C_0$-$C_8$ alkyl)OC(O)$C_1$-$C_{18}$ alkyl, $(C_0$-$C_8$ alkyl)OC(O)$C_2$-$C_{18}$ alkenyl, $(C_0$-$C_8$ alkyl)OC(O)$C_2$-$C_{18}$ alkynyl, $(C_0$-$C_8$ alkyl)C(O)$NR^{24}C_1$-$C_{18}$ alkyl, $(C_0$-$C_8$ alkyl)C(O)$NR^{24}C_2$-$C_{18}$ alkenyl, $(C_0$-$C_8$ alkyl)C(O)$NR^{24}C_2$-$C_{18}$ alkynyl, $(C_0$-$C_8$ alkyl)C(O)$NR^{24}H_2$, $(C_0$-$C_8$ alkyl)C(O)$NR^{24}$aryl, $(C_0$-$C_8$ alkyl)C(O)$NR^{24}$heteroaryl, $(C_0$-$C_8$ alkyl)$NR^{24}C(O)C_1$-$C_{18}$ alkyl, $(C_0$-$C_8$alkyl)$NR^{24}C(O)C_2$-$C_8$ alkenyl, or $(C_0$-$C_8$ alkyl)$NR^{24}C(O)C_2$-$C_{18}$ alkynyl, $(C_0$-$C_8$ alkyl)$NR^{24}C(O)OH$, $(C_0$-$C_8$ alkyl)OC(O)O$C_1$-$C_{18}$ alkyl, $(C_0$-$C_8$ alkyl)OC(O)O$C_2$-$C_{18}$ alkenyl, $(C_0$-$C_8$ alkyl)OC(O)O$C_2$-$C_{18}$ alkynyl, $(C_0$-$C_8$ alkyl) OC(O)OH, $(C_0$-$C_8$ alkyl)OC(O)$NR^{24}C_1$-$C_{18}$ alkyl, $(C_0$-$C_8$ alkyl)OC(O)$NR^{24}C_2$-$C_{18}$ alkenyl, $(C_0$-$C_8$ alkyl)OC(O)$NR^{24}C_2$-$C_{18}$ alkynyl, $(C_0$-$C_8$ alkyl)OC(O)$NR^{24}H_2$, $(C_0$-$C_8$ alkyl)$NR^{24}(O)OC_1$-$C_{18}$ alkyl, $(C_0$-$C_8$ alkyl)$NR^{24}(O)OC_2$-$C_{18}$ alkenyl, $(C_0$-$C_8$ alkyl)$NR^{24}(O)OC_2$-$C_{18}$ alkynyl, or $(C_0$-$C_8$ alkyl)$NR^{24}(O)OH$;

$R^3$ is hydrogen, $(C_0$-$C_8$ alkyl)halo, $C_1$-$C_{18}$ alkyl, $C_2$-$C_{18}$ alkenyl, $C_2$-$C_{18}$ alkynyl, heteroalkyl, $(C_0$-$C_8$ alkyl)aryl, $(C_0$-$C_8$ alkyl)heteroaryl, $(C_0$-$C_8$ alkyl)O$C_1$-$C_{18}$ alkyl, $(C_0$-$C_8$ alkyl)O$C_2$-$C_{18}$ alkenyl, $(C_0$-$C_8$ alkyl)O$C_2$-$C_{18}$ alkynyl, $(C_0$-$C_8$ alkyl)OH, $(C_0$-$C_8$ alkyl)SH, $(C_0$-$C_8$ alkyl)$NR^{24}C_1$-$C_{18}$ alkyl, $(C_0$-$C_8$ alkyl)$NR^{24}C_2$-$C_{18}$ alkenyl, $(C_0$-$C_8$ alkyl) $NR^{24}C_2$-$C_{18}$ alkynyl, $(C_0$-$C_8$alkyl)$NR^{24}H_2$, $(C_0$-$C_8$ alkyl)C(O)$C_1$-$C_{18}$ alkyl, $(C_0$-$C_8$ alkyl)C(O)$C_2$-$C_{18}$ alkenyl, $(C_0$-$C_8$ alkyl)C(O)$C_2$-$C_{18}$ alkynyl, $(C_0$-$C_8$ alkyl)C(O)H, $(C_0$-$C_8$ alkyl)C(O)aryl, $(C_0$-$C_8$ alkyl)C(O)heteroaryl, $(C_0$-$C_8$ alkyl)C(O)O$C_1$-$C_{18}$ alkyl, $(C_0$-$C_8$ alkyl)C(O)O$C_2$-$C_{18}$ alkenyl, $(C_0$-$C_8$ alkyl)C(O)O$C_2$-$C_{18}$ alkynyl, $(C_0$-$C_8$ alkyl)C(O)OH, $(C_0$-$C_8$ alkyl)C(O)O aryl, $(C_0$-$C_8$ alkyl)C(O)O heteroaryl, $(C_0$-$C_8$ alkyl)OC(O)$C_1$-$C_{18}$ alkyl, $(C_0$-$C_8$ alkyl)OC(O)$C_2$-$C_{18}$ alkenyl, $(C_0$-$C_8$ alkyl)OC(O)$C_2$-$C_{18}$ alkynyl, $(C_0$-$C_8$ alkyl)C(O)$NR^{24}C_1$-$C_{18}$ alkyl, $(C_0$-$C_8$ alkyl)C(O)$NR^{24}C_2$-$C_{18}$ alkenyl, $(C_0$-$C_8$ alkyl)C(O)$NR^{24}C_2$-$C_{18}$ alkynyl, $(C_0$-$C_8$ alkyl)C(O)$NR^{24}H_2$, $(C_0$-$C_8$ alkyl)C(O)$NR^{24}$aryl, $(C_0$-$C_8$ alkyl)C(O)$NR^{24}$heteroaryl, $(C_0$-$C_8$ alkyl)$NR^{24}C(O)C_1$-$C_{18}$ alkyl, $(C_0$-$C_8$alkyl)$NR^{24}C(O)C_2$-$C_8$ alkenyl, or $(C_0$-$C_8$ alkyl)$NR^{24}C(O)C_2$-$C_{18}$ alkynyl, $(C_0$-$C_8$ alkyl)$NR^{24}C(O)OH$, $(C_0$-$C_8$ alkyl)OC(O)O$C_1$-$C_{18}$ alkyl, $(C_0$-$C_8$ alkyl)OC(O)O$C_2$-$C_{18}$ alkenyl, $(C_0$-$C_8$ alkyl)OC(O)O$C_2$-$C_{18}$ alkynyl, $(C_0$-$C_8$ alkyl)OC(O) OH, $(C_0$-$C_8$ alkyl)OC(O)$NR^{24}C_1$-$C_{18}$ alkyl, $(C_0$-$C_8$alkyl)OC(O)$NR^{24}C_2$-$C_{18}$ alkenyl, $(C_0$-$C_8$ alkyl)OC(O)$NR^{24}C_2$-$C_{18}$ alkynyl, $(C_0$-$C_8$ alkyl)OC(O)$NR^{24}H_2$, $(C_0$-$C_8$ alkyl)$NR^{24}(O)OC_1$-$C_{18}$ alkyl, $(C_0$-$C_8$ alkyl)$NR^{24}(O)OC_2$-$C_{18}$ alkenyl, $(C_0$-$C_8$ alkyl)$NR^{24}(O)OC_2$-$C_{18}$ alkynyl, or $(C_0$-$C_8$ alkyl)$NR^{24}(O)$OH;

$R^4$ is hydrogen, $(C_0$-$C_8$ alkyl)halo, $C_1$-$C_{18}$ alkyl, $C_2$-$C_{18}$ alkenyl, $C_2$-$C_{18}$ alkynyl, heteroalkyl, $(C_0$-$C_8$ alkyl)aryl, $(C_0$-$C_8$ alkyl)heteroaryl, $(C_0$-$C_8$ alkyl)O$C_1$-$C_{18}$ alkyl, $(C_0$-$C_8$ alkyl)O$C_2$-$C_{18}$ alkenyl, $(C_0$-$C_8$ alkyl)O$C_2$-$C_{18}$ alkynyl, $(C_0$-$C_8$ alkyl)OH, $(C_0$-$C_8$ alkyl)SH, $(C_0$-$C_8$ alkyl)$NR^{24}C_1$-$C_{18}$ alkyl, $(C_0$-$C_8$ alkyl)$NR^{24}C_2$-$C_{18}$ alkenyl, $(C_0$-$C_8$ alkyl) $NR^{24}C_2$-$C_{18}$ alkynyl, $(C_0$-$C_8$alkyl)$NR^{24}H_2$, $(C_0$-$C_8$ alkyl)C(O)$C_1$-$C_{18}$ alkyl, $(C_0$-$C_8$ alkyl)C(O)$C_2$-$C_{18}$ alkenyl, $(C_0$-$C_8$ alkyl)C(O)$C_2$-$C_{18}$ alkynyl, $(C_0$-$C_8$ alkyl)C(O)H, $(C_0$-$C_8$ alkyl)C(O)aryl, $(C_0$-$C_8$ alkyl)C(O)heteroaryl, $(C_0$-$C_8$ alkyl)C(O)O$C_1$-$C_{18}$ alkyl, $(C_0$-$C_8$ alkyl)C(O)O$C_2$-$C_{18}$ alkenyl, $(C_0$-$C_8$ alkyl)C(O)O$C_2$-$C_{18}$ alkynyl, $(C_0$-$C_8$ alkyl)C(O)OH, $(C_0$-$C_8$ alkyl)C(O)O aryl, $(C_0$-$C_8$ alkyl)C(O)O heteroaryl, $(C_0$-$C_8$ alkyl)OC(O)$C_1$-$C_{18}$ alkyl, $(C_0$-$C_8$ alkyl)OC(O)$C_2$-$C_{18}$ alkenyl, $(C_0$-$C_8$ alkyl)OC(O)$C_2$-$C_{18}$ alkynyl, $(C_0$-$C_8$ alkyl)C(O)$NR^{24}C_1$-$C_{18}$ alkyl, $(C_0$-$C_8$ alkyl)C(O)$NR^{24}C_2$-$C_{18}$ alkenyl, $(C_0$-$C_8$ alkyl)C(O)$NR^{24}C_2$-$C_{18}$ alkynyl, $(C_0$-$C_8$ alkyl)C(O)$NR^{24}H_2$, $(C_0$-$C_8$ alkyl)C(O)$NR^{24}$aryl, $(C_0$-$C_8$ alkyl)C(O)$NR^{24}$heteroaryl, $(C_0$-$C_8$ alkyl)$NR^{24}C(O)C_1$-$C_{18}$ alkyl, $(C_0$-$C_8$alkyl)$NR^{24}C(O)C_2$-$C_8$ alkenyl, or $(C_0$-$C_8$ alkyl)$NR^{24}C(O)C_2$-$C_{18}$ alkynyl, $(C_0$-$C_8$ alkyl)$NR^{24}C(O)OH$, $(C_0$-$C_8$ alkyl)OC(O)O$C_1$-$C_{18}$ alkyl, $(C_0$-$C_8$ alkyl)OC(O)O$C_2$-$C_{18}$ alkenyl, $(C_0$-$C_8$ alkyl)OC(O)O$C_2$-$C_{18}$ alkynyl, $(C_0$-$C_8$ alkyl)OC(O) OH, $(C_0$-$C_8$ alkyl)OC(O)$NR^{24}C_1$-$C_{18}$ alkyl, $(C_0$-$C_8$alkyl)OC(O)$NR^{24}C_2$-$C_{18}$ alkenyl, $(C_0$-$C_8$ alkyl)OC(O)$NR^{24}C_2$-$C_{18}$ alkynyl, $(C_0$-$C_8$ alkyl)OC(O)$NR^{24}H_2$, $(C_0$-$C_8$ alkyl)$NR^{24}(O)OC_1$-$C_{18}$ alkyl, $(C_0$-$C_8$ alkyl)$NR^{24}(O)OC_2$-$C_{18}$ alkenyl, $(C_0$-$C_8$ alkyl)$NR^{24}(O)OC_2$-$C_{18}$ alkynyl, or $(C_0$-$C_8$ alkyl)$NR^{24}(O)$OH; and $R^{24}$ is hydrogen or $C_1$-$C_{18}$ alkyl.

In some embodiments, Y comprises a structure of Formula A wherein $R^1$ is present and is hydrogen, $C_1$-$C_7$ alkyl; $(C_0$-$C_3$ alkyl)$C(O)C_1$-$C_7$ alkyl, $(C_0$-$C_3$ alkyl)$C(O)$aryl, or $SO_3H$;

$R^2$ is present and is hydrogen, halo, OH, or $C_1$-$C_7$ alkyl;

$R^3$ is hydrogen, halo, OH, or $C_1$-$C_7$ alkyl;

$R^4$ is hydrogen, $(C_0$-$C_8$ alkyl)halo, $C_1$-$C_8$ alkyl, $C_2$-$C_8$ alkenyl, $C_{2-18}$ alkynyl, heteroalkyl, $(C_0$-$C_8$ alkyl)aryl, $(C_0$-$C_8$ alkyl)heteroaryl, $(C_0$-$C_8$ alkyl)$OC_1$-$C_8$ alkyl, $(C_0$-$C_8$ alkyl)$OC_2$-$C_8$ alkenyl, $(C_0$-$C_8$ alkyl)$OC_2$-$C_8$ alkynyl, $(C_0$-$C_8$ alkyl)OH, $(C_0$-$C_8$ alkyl)SH, $(C_0$-$C_8$ alkyl)$NR^{24}C_1$-$C_8$ alkyl, $(C_0$-$C_8$ alkyl)$NR^{24}C_2$-$C_8$ alkenyl, $(C_0$-$C_8$ alkyl)$NR^{24}C_2$-$C_8$ alkynyl, $(C_0$-$C_8$ alkyl)$NR^{24}H_2$, $(C_0$-$C_8$ alkyl)$C(O)C_1$-$C_8$ alkyl, $(C_0$-$C_8$ alkyl)$C(O)C_2$-$C_8$ alkenyl, $(C_0$-$C_8$ alkyl)$C(O)C_2$-$C_8$ alkynyl, $(C_0$-$C_8$ alkyl)$C(O)H$, $(C_0$-$C_8$ alkyl)$C(O)$aryl, $(C_0$-$C_8$ alkyl)$C(O)$heteroaryl, $(C_0$-$C_8$ alkyl)$C(O)OC_1$-$C_8$ alkyl, $(C_0$-$C_8$ alkyl)$C(O)OC_2$-$C_8$ alkenyl, $(C_0$-$C_8$ alkyl)$C(O)OC_2$-$C_8$ alkynyl, $(C_0$-$C_8$ alkyl)$C(O)OH$, $(C_0$-$C_8$ alkyl)$C(O)O$ aryl, $(C_0$-$C_8$ alkyl)$C(O)O$ heteroaryl, $(C_0$-$C_8$ alkyl)$OC(O)C_1$-$C_8$ alkyl, $(C_0$-$C_8$ alkyl)$OC(O)C_2$-$C_8$ alkenyl, $(C_0$-$C_8$ alkyl)$OC(O)C_2$-$C_{18}$ alkynyl, $(C_0$-$C_8$ alkyl)$C(O)NR^{24}C_1$-$C_8$ alkyl, $(C_0$-$C_8$ alkyl)$C(O)NR^{24}C_2$-$C_8$ alkenyl, $(C_0$-$C_8$ alkyl)$C(O)NR^{24}C_2$-$C_8$ alkynyl, $(C_0$-$C_8$ alkyl)$C(O)NR^{24}H_2$, $(C_0$-$C_8$ alkyl)$C(O)NR^{24}$aryl, $(C_0$-$C_8$ alkyl)$C(O)NR^{24}$heteroaryl, $(C_0$-$C_8$ alkyl)$NR^{24}C(O)C_1$-$C_8$ alkyl, $(C_0$-$C_8$ alkyl)$NR^{24}C(O)C_2$-$C_8$ alkenyl, or $(C_0$-$C_8$ alkyl)$NR^{24}C(O)C_2$-$C_8$ alkynyl, $(C_0$-$C_8$ alkyl)$NR^{24}C(O)OH$, $(C_0$-$C_8$ alkyl)$OC(O)OC_1$-$C_8$ alkyl, $(C_0$-$C_8$ alkyl)$OC(O)OC_2$-$C_8$ alkenyl, $(C_0$-$C_8$ alkyl)$OC(O)OC_2$-$C_8$ alkynyl, $(C_0$-$C_8$ alkyl)$OC(O)OH$, $(C_0$-$C_8$ alkyl)$OC(O)NR^{24}C_1$-$C_8$ alkyl, $(C_0$-$C_8$ alkyl)$OC(O)NR^{24}C_2$-$C_8$ alkenyl, $(C_0$-$C_8$ alkyl)$OC(O)NR^{24}C_2$-$C_8$ alkynyl, $(C_0$-$C_8$ alkyl)$OC(O)NR^{24}H_2$, $(C_0$-$C_8$ alkyl)$NR^{24}(O)OC_1$-$C_8$ alkyl, $(C_0$-$C_8$ alkyl)$NR^{24}(O)OC_2$-$C_8$ alkenyl, $(C_0$-$C_8$ alkyl)$NR^{24}(O)OC_2$-$C_8$ alkynyl, or $(C_0$-$C_8$ alkyl)$NR^{24}(O)OH$; and, $R^{24}$ is hydrogen or $C_1$-$C_7$ alkyl.

In some embodiments, $R^1$ is hydrogen, propionate, acetate, benzoate, or sulfate; $R^2$ is hydrogen or methyl; $R^3$ is hydrogen or methyl; and $R^4$ is acetate, cypionate, hemisucciniate, enanthate, or propionate.

In embodiments wherein Y comprises a structure of Formula A, Y is conjugated to L (e.g. when L is a linking group) or Q (e.g. when L is a bond) at any position of Formula A that is capable of reacting with Q or L. One skilled in the art could readily determine the position of conjugation on Formula A and means of conjugation of Formula A to Q or L in view of general knowledge and the disclosure provided herein. In some embodiments, Formula A is conjugated to L or Q at any of positions 1, 2, 3, 4, 5, 6, 7, 8, 9, 10, 11, 12, 13, 14, 15, 16, 17, 18, 19, or 20 of Formula A. In some embodiments, Formula A is conjugated to L or Q at position 1, 3, 6, 7, 12, 10, 13, 16, 17, or 19 of Formula A.

Free Fatty Acid or Derivative Thereof

In some embodiments of the invention, Y is a free fatty acid or derivative thereof, as shown in Formula B:

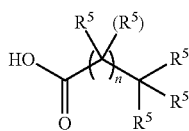

Formula B wherein n is 0-26 and each $R^5$, when present, are each independently a moiety that permits or promotes agonist or antagonist activity upon binding of the compound of Formula B to a GPCR. In some embodiments, Y comprises a structure of Formula B, wherein n is 0-26 and each $R^5$ is independently hydrogen, $C_1$-$C_7$ alkyl, or halogen. In some embodiments Formula B is saturated such as, for example, formic acid, acetic acid, n-caproic acid, heptanoic acid, caprylic acid, nonanoic acid, capric acid, undecanoic acid, lauric acid, tridecanoic acid, myristic acid, pentadeconoic acid, palmitic acid, heptadecanoic acid, stearic acid, nonadecanoic acid, arachidic acid, heneicosanoic acid, behenic acid, tricosanoic acid, and derivatives thereof. In some embodiments Formula B is unsaturated with either cis or trans stereochemistry such as, for example, mead acid, myristoleic acid, palmitoleic acid, sapienic acid, oleic acid, linoleic acid, α-linolenic acid, elaidic acid, petroselinic acid, arachidonic acid, dihydroxyeicosatetraenoic acid (DiHETE), octadecynoic acid, eicosatriynoic acid, eicosadienoic acid, eicosatrienoic acid, eicosapentaenoic acid, erucic acid, dihomolinolenic acid, docosatrienoic acid, docosapentaenoic acid, docosahexaenoic acid, adrenic acid, and derivatives thereof.

In some embodiments Formula B is a saturated or unsaturated short chain fatty acid, wherein n is 0-3. In some embodiments, Formula B is a saturated or unsaturated medium chain fatty acid, wherein n is 4-10. In some embodiments, Formula B is a saturated or unsaturated long chain fatty acid, wherein n is 11-20. In some embodiments, Formula B is a saturated or unsaturated very long chain fatty acid, wherein n is 21-26.

In some embodiments, the tail of Formula B is further modified to comprise a moiety such as a carboxylic acid, a carboxylic acid derivative, or amide. For example, a modified compound of Formula B can include MEDICA16, as shown below:

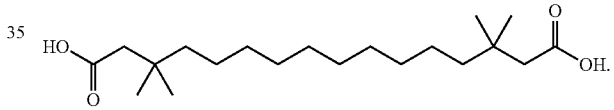

In embodiments wherein Y comprises a structure of Formula B, Y is conjugated to L (e.g. when L is a linking group) or Q (e.g. when L is a bond) at any position of Formula B that is capable of reacting with Q or L. One skilled in the art could readily determine the position of conjugation on Formula B and means of conjugation of Formula B to Q or L in view of general knowledge and the disclosure provided herein. In some embodiments, Formula B is conjugated to L or Q at any position on Formula B. In some embodiments, Formula B is conjugated to L or Q through a terminal carboxylic acid moiety.

Free Fatty Amide or Derivative Thereof

In some embodiments of the invention, Y is a free fatty amide or derivative thereof, as shown in Formula C:

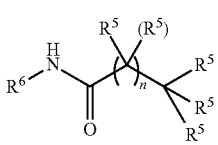

Formula C wherein n is 0-26 and each $R^5$, when present, is independently a moiety that permits or promotes agonist or antagonist activity upon binding of the compound of Formula C to a GPCR. In some embodiments, Y comprises a structure of Formula C, wherein n is 0-26; each $R^5$, when present, is independently hydrogen, or $C_1$-$C_7$ alkyl, halogen; and $R^6$ is hydrogen, $C_1$-$C_{18}$ alkyl, ($C_1$-$C_{18}$ alkyl)OH, ($C_1$-$C_{18}$ alkyl)NH$_2$, ($C_0$-$C_8$ alkyl)halo, $C_2$-$C_{18}$ alkenyl, $C_2$-$C_{18}$ alkynyl, heteroalkyl, ($C_0$-$C_8$ alkyl)aryl, or ($C_0$-$C_8$ alkyl)heteroaryl. In some embodiments Formula C is saturated, while in other embodiments, Formula C is unsaturated with either cis or trans stereochemistry.

In some embodiments, Y comprises a structure of Formula C, wherein n is 4-26; each $R^5$, when present, is hydrogen; and $R^6$ is hydrogen. For example, Y can include oleamide, as shown below:

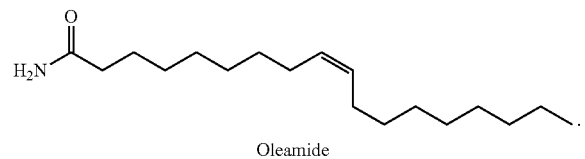 [SMILES: CCCCCCCC/C=C\CCCCCCCC(N)=O]

Oleamide

In some embodiments, Y comprises a structure of Formula C, wherein n is 4-26; each $R^5$, when present, is independently hydrogen or halogen; and $R^6$ is ($C_1$-$C_8$ alkyl)OH. Nonlimiting examples of compounds of Formula C when $R^6$ is ($C_1$-$C_8$ alkyl)OH include:

In some embodiments, Y comprises a structure of Formula C, wherein n is 4-26; each $R^5$, when present, is independently hydrogen or halogen; and $R^6$ is ($C_1$-$C_3$ alkyl)aryl. For example, Y can include N-oleoyldopamine, as shown below:

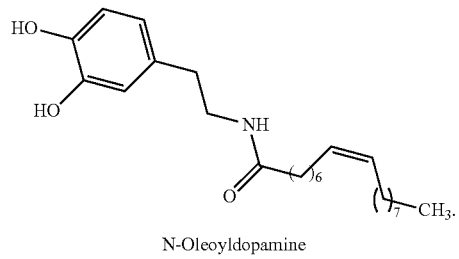

N-Oleoyldopamine

In embodiments wherein Y comprises a structure of Formula C, Y is conjugated to L (e.g. when L is a linking group) or Q (e.g. when L is a bond) at any position of Formula C that is capable of reacting with Q or L. One skilled in the art could readily determine the position of conjugation on Formula C and means of conjugation of Formula C to Q or L in view of general knowledge and the disclosure provided herein. In some embodiments, Formula C is conjugated to L or Q at any

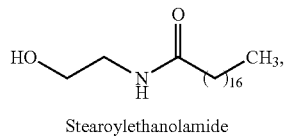

Stearoylethanolamide

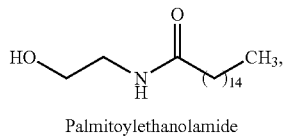

Palmitoylethanolamide

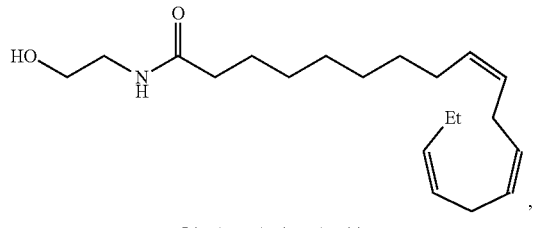

Linolenoyl ethanolamide

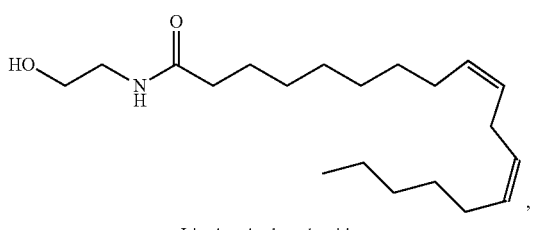

Linoleoyl ethanolamide

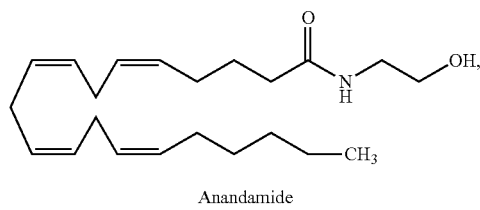

Anandamide

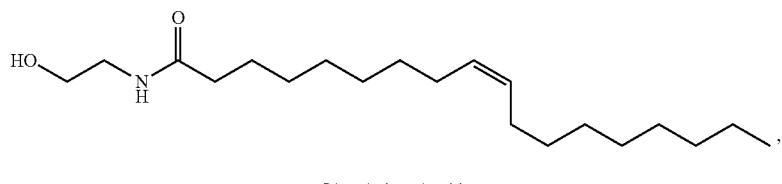

Oleoylethanolamide and derivatives thereof.

position on Formula C. In some embodiments, Formula C is conjugated to L or Q through a terminal carboxylic acid or through a hydroxyl moiety.

Phospholipid or Derivative Thereof

In some embodiments of the invention, Y is a phospholipid or derivative thereof, as shown in Formula D:

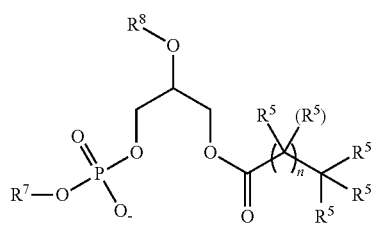

Formula D wherein n is 0-26, each $R^5$, $R^7$, and $R^8$ are moieties that permit or promote agonist or antagonist activity upon binding of the compound of Formula D to a GPCR. In some embodiments, Y comprises a structure of Formula D, wherein n is 0-26; each $R^5$, when present, is independently hydrogen, $C_1$-$C_7$ alkyl, or halogen; $R^7$ is choline, ethanolamine, or inositol; and $R^8$ is hydrogen or

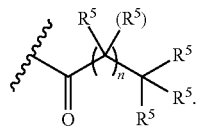

In some embodiments Formula D is saturated, while in other embodiments, Formula D is unsaturated with either cis or trans stereochemistry.

In some embodiments, Y comprises a structure of Formula D, wherein each n is independently 4-26; each $R^5$, when present, is independently hydrogen or halogen; $R^7$ is choline; and $R^8$ is

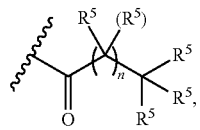

as shown below:

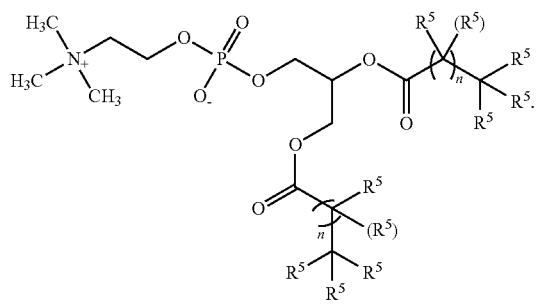

For example, Y can include 1-palmitoyl-2-oleo-sn-glycero-3-phosphocholine, as shown below:

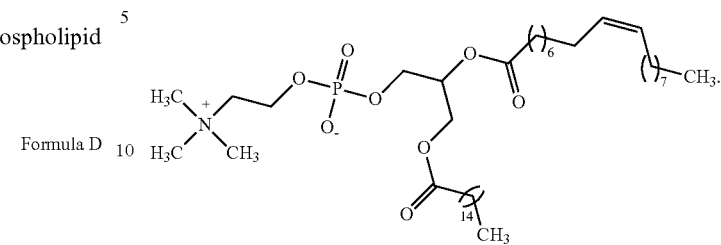

In some embodiments, Y comprises a structure of Formula D, wherein n is 4-26; each $R^5$, when present, is independently hydrogen or halogen; $R^7$ is choline; and $R^8$ is acetyl, as shown below:

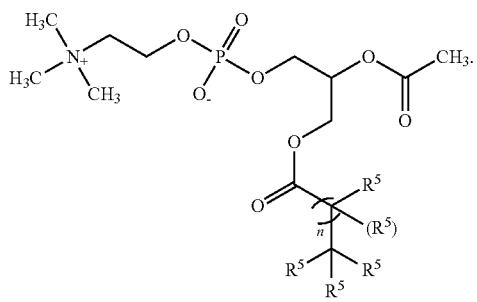

In some embodiments, Y comprises a structure of Formula D, wherein n is 4-26; each $R^5$, when present, is independently hydrogen or halogen; $R^7$ is choline; and $R^8$ is OH, as shown below:

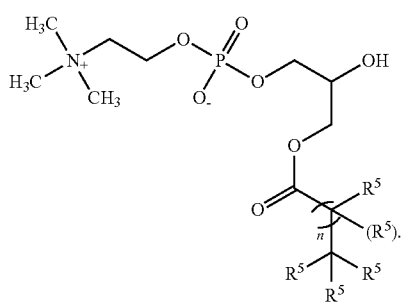

Nonlimiting examples of Y in these embodiments include:

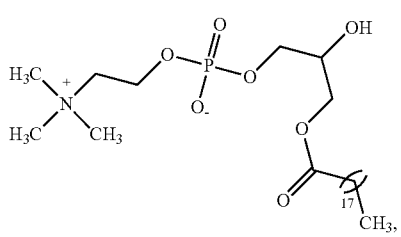

-continued

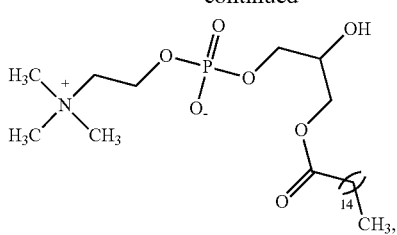

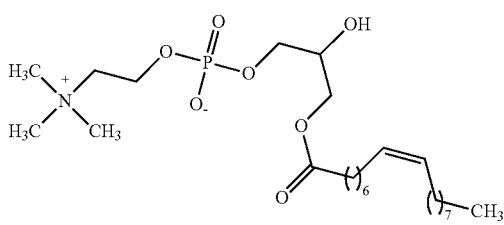

and derivatives thereof.

In some embodiments, Y comprises a structure of Formula D, wherein n is 4-26; each $R^5$, when present, is independently hydrogen or halogen; $R^7$ is ethanolamine, and $R^8$ is OH, as shown below:

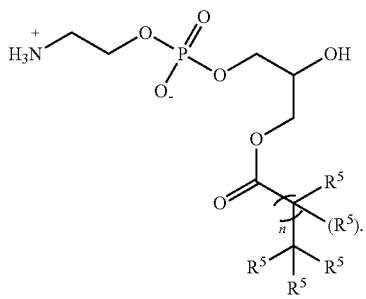

Nonlimiting examples of Y in these embodiments include:

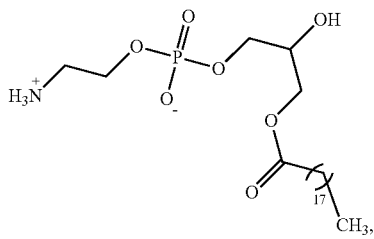

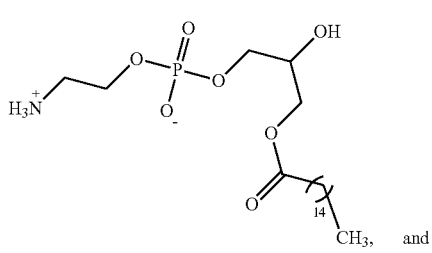

and

-continued

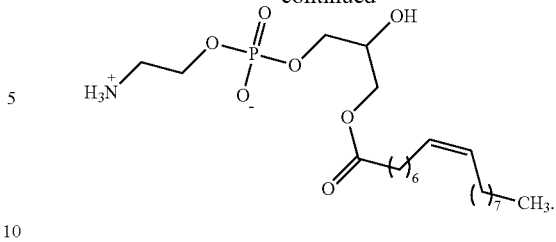

In some embodiments, Y comprises a structure of Formula D, wherein n is 4-26; each $R^5$, when present, is independently hydrogen or halogen; $R^7$ is inositol, and $R^8$ is OH, as shown below:

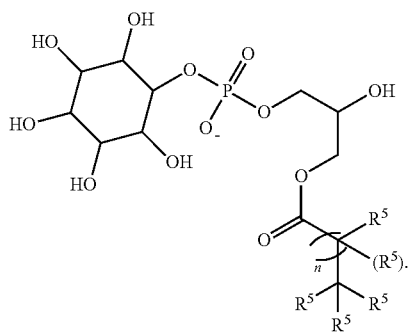

Nonlimiting examples of Y in these embodiments include:

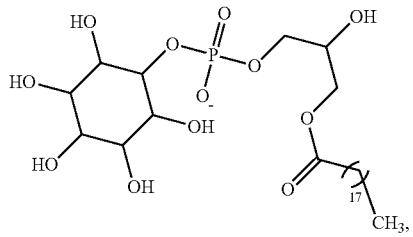

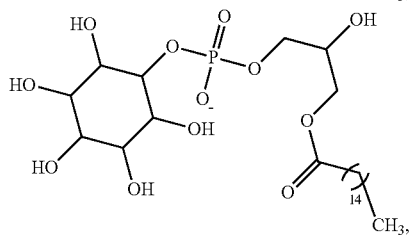

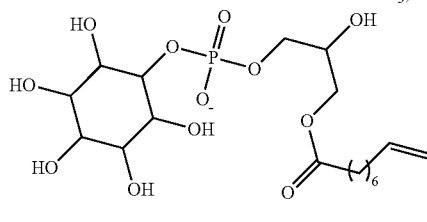

and derivatives thereof.

In embodiments wherein Y comprises a structure of Formula D, Y is conjugated to L (e.g. when L is a linking group) or Q (e.g. when L is a bond) at any position of Formula D that is capable of reacting with Q or L. One skilled in the art could readily determine the position of conjugation on Formula D and means of conjugation of Formula D to Q or L in view of general knowledge and the disclosure provided herein. In some embodiments, Formula D is conjugated to L or Q through a terminal carboxylic acid, amino, or hydroxyl moiety.

Grifolic Acid or Derivative Thereof

In some embodiments of the invention, Y is grifolic acid or derivative thereof, as shown in Formula E:

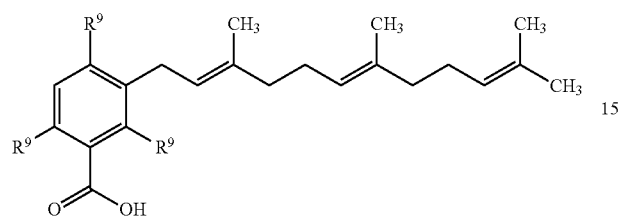

Formula E wherein each $R^9$ is independently a moiety that permits or promotes agonist or antagonist activity upon binding of the compound of Formula E to a GPCR. In some embodiments, Y comprises a structure of Formula E, wherein each $R^9$ is independently hydrogen, OH, or O($C_1$-$C_8$ alkyl). Nonlimiting examples of Y in these embodiments include grifolic acid and grifolic acid methyl ether, shown below:

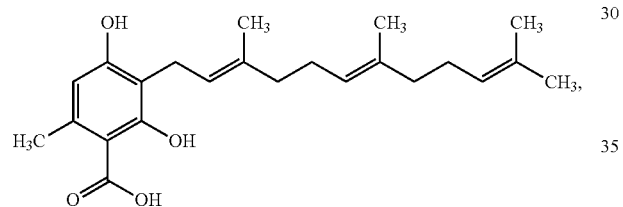

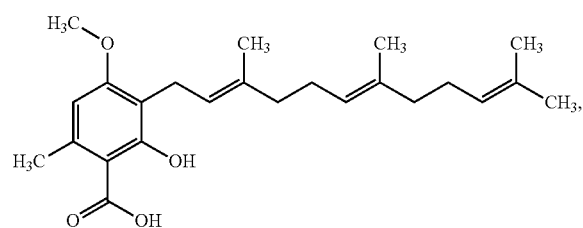

and derivatives thereof.

In embodiments wherein Y comprises a structure of Formula E, Y is conjugated to L (e.g. when L is a linking group) or Q (e.g. when L is a bond) at any position of Formula E that is capable of reacting with Q or L. One skilled in the art could readily determine the position of conjugation on Formula E and means of conjugation of Formula E to Q or L in view of general knowledge and the disclosure provided herein. In some embodiments, Formula E is conjugated to L or Q at any position on Formula E. In some embodiments, Formula E is conjugated to L or Q through a carboxylic acid or hydroxyl moiety.

Diacetylphloroglucinol or Derivative Thereof

In some embodiments of the invention, Y is diacetylphloroglucinol or derivative thereof, as shown in Formula F:

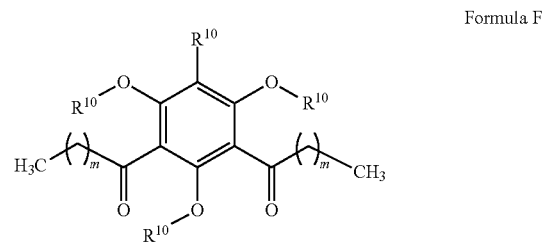

Formula F wherein each m is independently 0-15, and each $R^{10}$ is independently a moiety that permits or promotes agonist or antagonist activity upon binding of the compound of Formula F to a GPCR. In some embodiments, Y comprises a structure of Formula F, wherein each m is independently 0-15; and each $R^{10}$ is independently hydrogen or $C_1$-$C_{18}$ alkyl. In some embodiments, Y is a compound of Formula F, wherein each m is 9 and each $R^{10}$ is hydrogen, as shown below:

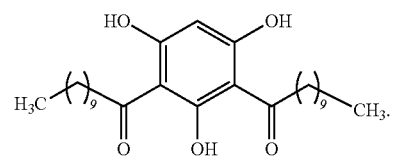

In embodiments wherein Y comprises a structure of Formula F, Y is conjugated to L (e.g. when L is a linking group) or Q (e.g. when L is a bond) at any position of Formula F that is capable of reacting with Q or L. One skilled in the art could readily determine the position of conjugation on Formula F and means of conjugation of Formula F to Q or L in view of general knowledge and the disclosure provided herein. In some embodiments, Formula F is conjugated to L or Q at any position on Formula F. In some embodiments, Formula F is conjugated to L or Q through a hydroxyl moiety.

Retinoic Acid or Derivative Thereof

In some embodiments, Y is retinoic acid or a derivative thereof, as shown in Formula G:

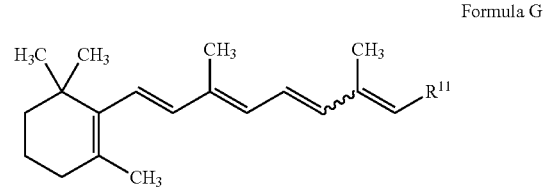

Formula G wherein $R^{11}$ is a moiety that permits or promotes agonist or antagonist activity upon the binding of the compound of Formula G to a GPCR, and ∿ represents either E or Z stereochemistry. In some embodiments, Y comprises a structure of Formula G wherein $R^{11}$ is C(O)OH, $CH_2OH$, or C(O)H. In some embodiments, Y comprises a structure of Formula G wherein $R^{11}$ is a carboxylic acid derivative. Nonlimiting examples of the compound of Formula G include:

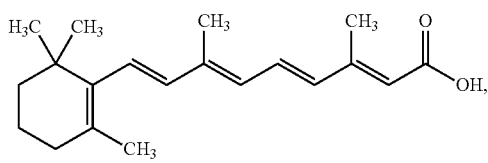

All-trans-retinoic acid

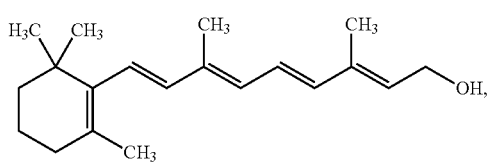

Retinol

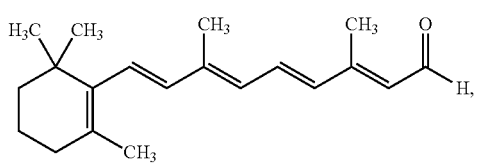

Retinal

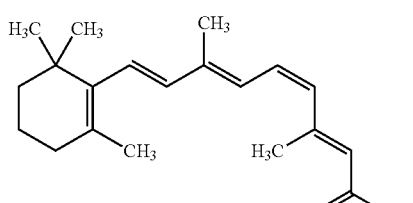

11-cis-retinoic acid and derivatives thereof.

In embodiments wherein Y comprises a structure of Formula G, Y is conjugated to L (e.g. when L is a linking group) or Q (e.g. when L is a bond) at any position of Formula G that is capable of reacting with Q or L. One skilled in the art could readily determine the position of conjugation on Y and means of conjugation of Y to Q or L in view of general knowledge and the disclosure provided herein. In some embodiments, Y is conjugated to L or Q through any position of Y. In some embodiments, Formula G is conjugated to L or Q at $R^{11}$.

Thiazolidinedione Derivative

In some exemplary embodiments, Y is a thiazolidinedione compound comprising a structure as described by Formula H:

Formula H

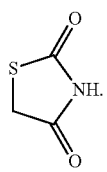

Nonlimiting examples of the compound of Formula H include:

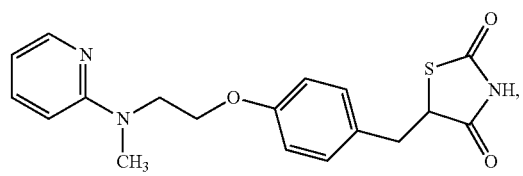

Rosiglitazone

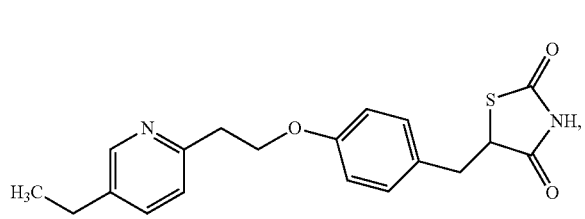

Pioglitazone

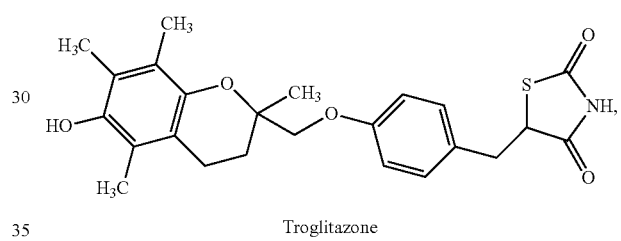

Troglitazone

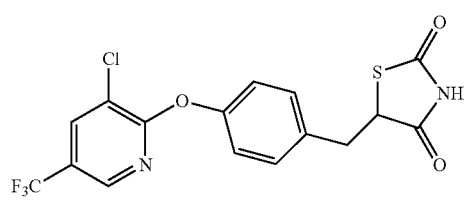

and derivatives thereof.

In embodiments wherein Y comprises a structure of Formula H, Y is conjugated to L (e.g. when L is a linking group) or Q (e.g. when L is a bond) at any position of Formula H that is capable of reacting with Q or L. One skilled in the art could readily determine the position of conjugation on Formula H and means of conjugation of Formula H to Q or L in view of general knowledge and the disclosure provided herein. In some embodiments, Formula H is conjugated to L or Q through a hydroxyl moiety, through an aromatic moiety, or through a carboxylic acid of Formula H.

GPCR Ligands of Low Molecular Weight

In some embodiments of the invention, Y is small molecule having a molecular weight of up to about 5000 daltons, or up to about 2000 daltons, or up to about 1000 daltons, or up to about 500 daltons that permits or promotes agonist or antagonist activity at a GPCR. In some embodiments, Y is 1000 daltons or less. Nonlimiting examples of small molecules that permit or promote agonist or antagonist activity at a GPCR include:

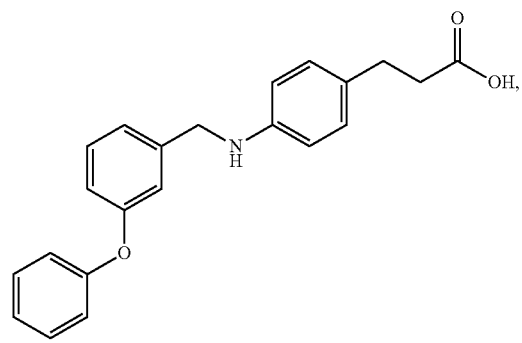

4-(Benzylamino)dihydrocinnamic acid)
(GW9508)

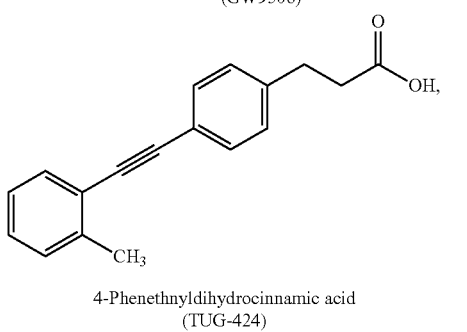

4-Phenethnyldihydrocinnamic acid
(TUG-424)

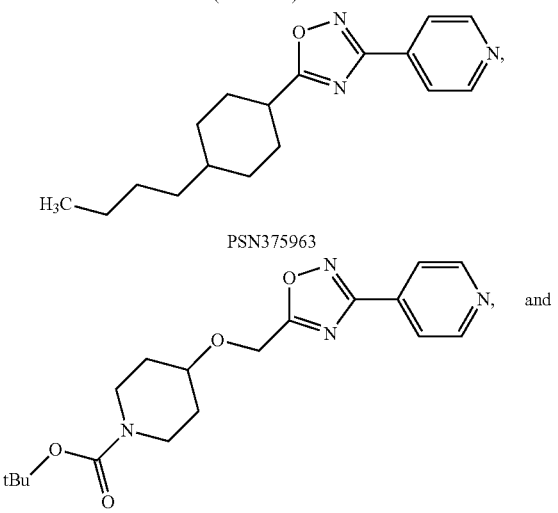

PSN375963

PSN632408

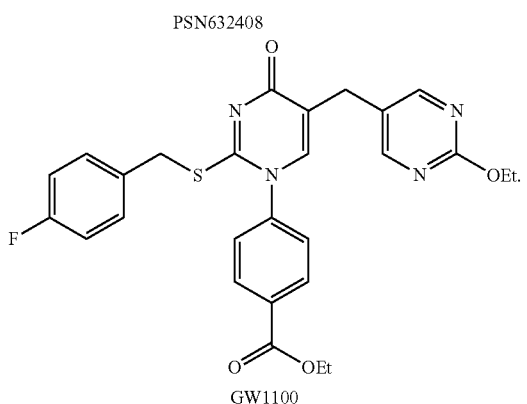

GW1100

In the embodiments wherein Y is a GPCR ligand of low molecular weight, Y is conjugated to L (e.g. when L is a linking group) or Q (e.g. when L is a bond) at any position of Y that is capable of reacting with Q or L. One skilled in the art could readily determine the position of conjugation on Y and means of conjugation of Y to Q or L in view of general knowledge and the disclosure provided herein. In some embodiments, Y is conjugated to L or Q through any position of Y, such as, for example, a carboxylic acid or an alcohol moiety.

4-Phenoxymethylpiperidines

In some embodiments of the invention, Y is a 4-phenoxymethylpiperidine or derivative thereof, as shown in Formula J:

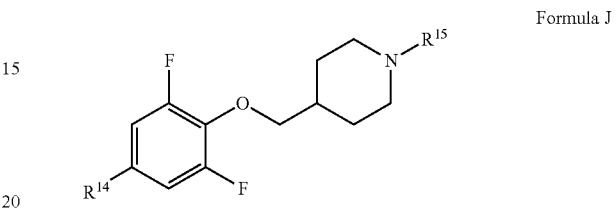

Formula J wherein $R^{14}$ and $R^{15}$ are each moieties that permits or promotes agonist or antagonist activity at a GPCR. In some embodiments, Y comprises a structure of Formula J wherein $R^{14}$ is phenyl, pyridin-2-yl, pyridin-3-yl, pyridin-4-yl, pyrimidin-5-yl, pyrazol-4-yl, 1H-pyrazol-4-yl, 6-oxo-1,6-dihydropyridin-3-yl, 2-oxo-1,2-dihydropyrimidin-5-yl, 2-oxo-1,2-dihydropyridin-4-yl and 2-oxo-2,3-dihydrooxazolo[4,5-b]pyridin-6-yl;

wherein said phenyl, pyridin-2-yl, pyridin-3-yl, pyridin-4-yl, pyrimidin-5-yl, pyrazol-4-yl, 1H-pyrazol-4-yl, 6-oxo-1,6-dihydropyridin-3-yl, 2-oxo-1,2-dihydropyrimidin-5-yl, 2-oxo-1,2-dihydropyridin-4-yl or 2-oxo-2,3-dihydrooxazolo[4,5-b]pyridin-6-yl of $R^{14}$ is optionally substituted with 1 to 3 radicals independently selected from halo, $-X^1R^{16}$, $-X^1OR^{16}$, $-X^1C(O)R^{16}$, $-X^1C(O)OR^{16}$, $-X^2NR^{16}C(O)R^{16}$, $-X^1S(O)_2R^{16}$, $-X^1NR^{16}S(O)_2R^{16}$, $-X^1C(O)NR^{16}R^{17}$, $-X^1C(O)NR^{16}X^2OR^{17}$, $-X^1C(O)NR^{16}X^2NR^{16}R^{17}$, $-X^1C(O)NR^{16}X^2C(O)OR^{17}$, $-X^1S(O)_2X^2R^{16}$, $-X^1S(O)_{0-2}X^2OR^{16}$, $-X^2CN$, $-X^1OX^2R^{16}$, $-X^1NR^{17}X^2R^{16}$, $-X^2NR^{16}R^{17}$, $-X^1S(O)_{0-2}X^2C(O)R^{16}$, $-X^1S(O)_{0-2}X^2C(O)OR^{16}$ and $-X^1S(O)_{0-2}NR^{16}R^{17}$;

wherein $X^1$ is selected from a bond, O, $NR^{17}$ and $C_{1-4}$alkyl; $R^{17}$ is selected from hydrogen and $C_{1-6}$alkyl;

each $X^2$ is independently selected from a bond and $C_{1-4}$alkyl;

each $R^{16}$ is independently selected from hydrogen, $C_{1-6}$alkyl, $C_{6-10}$aryl, $C_{1-10}$heteroaryl, $C_{3-8}$heterocycloalkyl, $C_{3-8}$cycloalkyl and $-X^3C(O)OR^{18}$, $-X^3R^{18}$, $-X^3OR^{18}$, $-X^3NR^{18}R^{19}$;

wherein said alkyl, aryl, heteroaryl, cycloalkyl and heterocycloalkyl of $R^{16}$ is optionally substituted with 1 to 3 radicals independently selected from hydroxy, halo, amino, cyano, $C_{1-6}$alkyl, halo-substituted-$C_{1-6}$alkyl, hydroxy-substituted-$C_{1-6}$alkyl, $C_{1-6}$alkoxy, halo-substituted-$C_{1-6}$alkoxy, $C_{6-10}$aryl-$C_{1-4}$alkoxy and $-NR^{18}C(O)R^{19}$; $X^3$ is $C_{1-3}$alkyl; and $R^{18}$ is selected from hydrogen, $C_{1-6}$alkyl and $C_{3-8}$heterocycloalkyl optionally substituted with $C_{1-6}$alkyl;

$R^{19}$ are independently selected from hydrogen and $C_{1-6}$alkyl;

and $R^{15}$ is selected from $R^{20}$ and $-C(O)OR^{20}$;

wherein $R^{20}$ is selected from $C_{1-6}$alkyl, $C_{6-10}$aryl, $C_{1-10}$heteroaryl, $C_{3-8}$cycloalkyl and $C_{3-8}$heterocycloalkyl;

wherein said alkyl, aryl, heteroaryl, cycloalkyl or heterocycloalkyl of $R^{20}$ is optionally substituted with 1 to 3 radicals independently selected from halo, $C_{1-6}$alkyl, $C_{3-12}$cycloalkyl, $C_{3-8}$heterocycloalkyl, halo-substituted-$C_{1-6}$alkyl, hydroxy-substituted-$C_{1-6}$alkyl, and halo-substituted-$C_{1-6}$alkoxy; or the pharmaceutically acceptable salts thereof.

Nonlimiting examples of 4-phenoxymethylpiperidine compounds that permit or promote agonist or antagonist activity at a GPCR include: 2-(4-((2,6-difluoro-4-(5-(methylsulfonyl)pyridin-2-yl)phenoxy)methyl)piperidin-1-yl)-5-ethylpyrimidine; tert-butyl 4-((3,5-difluoro-4'-(methylsulfonyl)biphenyl-4-yloxy)methyl)piperidine-1-carboxylate; 2-(4-((3,5-difluoro-4'-(3-methyloxetan-3-yl)methylsulfonyl)biphenyl-4-yloxy)methyl)piperidin-1-yl)-5-ethylpyrimidine; 2-(4((3,5-difluoro-4'-(isobutylsulfonyl)biphenyl-4-yloxy)methyl)piperidin-1-yl)-5-ethylpyrimidine; 2-(4-((3,5-difluoro-4'-(propylsulfonyl)biphenyl-4-yloxy)methyl)piperidin-1-yl)-5-ethylpyrimidine; 2-(4-((3,5-difluoro-4'-(methylsulfonyl)biphenyl-4-yloxy)methyl)piperidin-1-yl)-5-ethylpyrimidine; 2-(4-((3,5-difluoro-4'-(isopropylsulfonyl)biphenyl-4-yloxy)methyl)piperidin-1-yl)-5-ethylpyrimidine; 4'-((1-(5-ethylpyrimidin-2-yl)piperidin-4-yl)methoxy)-3',5'-difluorobiphenyl-4-carbonitrile; 4'4(1-(5-ethylpyrimidin-2-yl)piperidin-4-yl)methoxy)-3',5'-difluorobiphenyl-3-carbonitrile; 2(4'-((1-(5-ethylpyrimidin-2-yl)piperidin-4-yl)methoxy)-3',5'-difluorobiphenyl-3-yl)acetonitrile; 2-(((1-(5-ethylpyrimidin-2-yl)piperidin-4-yl)methoxy)-3',5'-difluorobiphenyl-3-yl)methanol; 2-(4-((3,5-difluoro-3'-(methylsulfonyl)biphenyl-4-yloxy)methyl)piperidin-1-yl)-5-ethylpyrimidine; 2-(4'-((1-(5-ethylpyrimidin-2-yl)piperidin-4-yl)methoxy)-3',5'-difluorobiphenyl-4-yl)acetonitrile; (4'-(4(1-(5-ethylpyrimidin-2-yl)piperidin-4-yl)methoxy)-3',5'-difluorobiphenyl-4-yl)methanol; 2-(4-((2,6-difluoro-4-(2-(pyrrolidin-1-yl)pyrimidin-5-yl)phenoxy)methyl)piperidin-1-yl)-5-ethylpyrimidine; 2-(4-((2,6-difluoro-4-(pyrimidin-5-yl)phenoxy)methyl)piperidin-1-yl)-5-ethylpyrimidine; 2-(4-((3,5-difluorobiphenyl-4-yloxy)methyl)piperidin-1-yl)-5-ethylpyrimidine; 2-(4-((2,6-difluoro-4-(pyridin-4-yl)phenoxy)methyl)piperidin-1-yl)-5-ethylpyrimidine; tert-butyl 4-((2,6-difluoro-4-(2-methoxypyridin-4-yl)phenoxy)methyl)piperidine-1-carboxylate; tert-butyl 4-((2,6-difluoro-4-(pyridin-4-yl)phenoxy)methyl)piperidine-1-carboxylate; 2-(4-((2,6-difluoro-4-(6-(methylsulfonyl)pyridin-3-yl)phenoxy)methyl)piperidin-1-yl)-5-ethylpyrimidine; 2-(4-((4-(6-chloro-2-methylpyridin-3-yl)-2,6-difluorophenoxy)methyl)piperidin-1-yl)-5-ethylpyrimidine; 2-(4-((2,6-difluoro-4-(1-methyl-1H-pyrazol-4-yl)phenoxy)methyl)piperidin-1-yl)-5-ethylpyrimidine; 2-(4-((2,6-difluoro-4-(1H-pyrazol-4-yl)phenoxy)methyl)piperidin-1-yl)-5-ethylpyrimidine; 5-(4-((1-(5-ethylpyrimidin-2-yl)piperidin-4-yl)methoxy)-3,5-difluorophenyl)picolinonitrile; 2-(4-((2,6-difluoro-4-(3-methoxypyridin-4-yl)phenoxy)methyl)piperidin-1-yl)-5-ethylpyrimidine; N-(4'-((1-(5-ethylpyrimidin-2-yl)piperidin-4-yl)methoxy)-3',5'-difluorobiphenyl-4-yl)acetamide; N-((4'-((1-(5-ethylpyrimidin-2-yl)piperidin-4-yl)methoxy)-3',5'-difluorobiphenyl-4-yl)methanesulfonamide; 2-(4-((4-(6-(benzyloxy)pyridin-3-yl)-2,6-difluorophenoxy)methyl)piperidin-1-yl)-5-ethylpyrimidine; 5-(4-((1-(5-ethylpyrimidin-2-yl)piperidin-4-yl)methoxy)-3,5-difluorophenyl)pyridin-2(1H)-one; 2-(4-((2,6-difluoro-4-(2-methoxypyrimidin-5-yl)phenoxy)methyl)piperidin-1-yl)-5-ethylpyrimidine; 5-(4-((1-(5-ethylpyrimidin-2-yl)piperidin-4-yl)methoxy)-3,5-difluorophenyl)pyrimidin-2(1H)-one; 5-(4-((1-(5-ethylpyrimidin-2-yl)piperidin-4-yl)methoxy)-3,5-difluorophenyl)pyrimidine-2-carboxamide; tert-butyl 4-((2,6-difluoro-4-(pyridin-3-yl)phenoxy)methyl)piperidine-1-carboxylate; 5-(4-((1-(5-ethylpyrimidin-2-yl)piperidin-4-yl)methoxy)-3,5-difluorophenyl)pyrimidine-2-carboxylic acid; 2-(5-(4-((1-(5-ethylpyrimidin-2-yl)piperidin-4-yl)methoxy)-3,5-difluorophenyl)pyridin-2-yl)propan-2-ol; 2-(4-((3,5-difluoro-4'-(1H-tetrazol-5-yl)biphenyl-4-yloxy)methyl)piperidin-1-yl)-5-ethylpyrimidine; 2-(4-((3,5-difluoro-3'-(2H-tetrazol-5-yl)biphenyl-4-yloxy)methyl)piperidin-1-yl)-5-ethylpyrimidine; 2-(4-((3'-((2H-tetrazol-5-yl)methyl)-3,5-difluorobiphenyl-4-yloxy)methyl)piperidin-1-yl)-5-ethylpyrimidine; 2-(4-((4'-((2H-tetrazol-5-yl)methyl)-3,5-difluorobiphenyl-4-yloxy)methyl)piperidin-1-yl)-5-ethylpyrimidine; 2-(4-((4-(6-(2H-tetrazol-5-yl)pyridin-3-yl)-2,6-difluorophenoxy)methyl)piperidin-1-yl)-5-ethylpyrimidine; 2-(4-((3,5-difluoro-4'-(2-methyl-2H-tetrazol-5-yl)biphenyl-4-yloxy)methyl)piperidin-1-yl)-5-ethylpyrimidine; 2-(4-((3,5-difluoro-4'-(1-methyl-1H-tetrazol-5-yl)biphenyl-4-yloxy)methyl)piperidin-1-yl)-5-ethylpyrimidine; 2-(4-((3,5-difluoro-3'-(2-methyl-2H-tetrazol-5-yl)biphenyl-4-yloxy)methyl)piperidin-1-yl)-5-ethylpyrimidine; 2-(4-((3,5-difluoro-3'-(1-methyl-1H-tetrazol-5-yl)biphenyl-4-yloxy)methyl)piperidin-1-yl)-5-ethylpyrimidine; 2-(4-((3,5-difluoro-3'-((2-methyl-2H-tetrazol-5-yl)methyl)biphenyl-4-yloxy)methyl)piperidin-1-yl)-5-ethylpyrimidine; 2-(4-((3,5-difluoro-3'-((1-methyl-1H-tetrazol-5-yl)methyl)biphenyl-4-yloxy)methyl)piperidin-1-yl)-5-ethylpyrimidine; 2-(4-((3,5-difluoro-4'-((2-methyl-2H-tetrazol-5-yl)methyl)biphenyl-4-yloxy)methyl)piperidin-1-yl)-5-ethylpyrimidine; 2-(4-((3,5-difluoro-4'-((1-methyl-1H-tetrazol-5-yl)methyl)biphenyl-4-yloxy)methyl)piperidin-1-yl)-5-ethylpyrimidine; 2-(4-((2,6-difluoro-4-(6-(2-methyl-2H-tetrazol-5-yl)pyridin-3-yl)phenoxy)methyl)piperidin-1-yl)-5-ethylpyrimidine; 2-(4-((2,6-difluoro-4-(6-(1-methyl-1H-tetrazol-5-yl)pyridin-3-yl)phenoxy)methyl)piperidin-1-yl)-5-ethylpyrimidine; 1-methylcyclopropyl 4-((3,5-difluoro-4'-(methylsulfonyl)biphenyl-4-yloxy)methyl)piperidine-1-carboxylate; 4-(4-((1-(tert-butoxycarbonyl)piperidin-4-yl)methoxy)-3,5-difluorophenyl)pyridine 1-oxide; tert-butyl 4-((2,6-difluoro-4-(2-oxo-1,2-dihydropyridin-4-yl)phenoxy)methyl)piperidine-1-carboxylate; tert-butyl 4-((2,6-difluoro-4-(1-methyl-2-oxo-1,2-dihydropyridin-4-yl)phenoxy)methyl)piperidine-1-carboxylate; 2-(4-((2,6-difluoro-4-(2-methyl-6-(1H-1,2,4-triazol-1-yl)pyridin-3-yl)phenoxy)methyl)piperidin-1-yl)-5-ethylpyrimidine; 2-(4-((2,6-difluoro-4-(2-methyl-6-(methylsulfonyl)pyridin-3-yl)phenoxy)methyl)piperidin-1-yl)-5-ethylpyrimidine; 5-(4'-((1-(5-ethylpyrimidin-2-yl)piperidin-4-yl)methoxy)-3',5'-difluorobiphenyl-4-yl)oxazole; 2-(4-((3,5-difluoro-4'-(1H-pyrazol-3-yl)biphenyl-4-yloxy)methyl)piperidin-1-yl)-5-ethylpyrimidine; 1-(4'-((1-(5-ethylpyrimidin-2-yl)piperidin-4-yl)methoxy)-3',5'-difluorobiphenyl-4-yl)-N-methylmethanamine; N-((4'-((1-(5-ethylpyrimidin-2-yl)piperidin-4-yl)methoxy)-3',5'-difluorobiphenyl-4-yl)methyl)-2-methylpropan-2-amine; 4-((4'-((1-(5-ethylpyrimidin-2-yl)piperidin-4-yl)methoxy)-3',5'-difluorobiphenyl-4-yl)methyl)morpholino; 2-(4-((4'-((1H-imidazol-1-yl)methyl)-3,5-difluorobiphenyl-4-yloxy)methyl)piperidin-1-yl)-5-ethylpyrimidine; 2-(4-((4'-(2H-tetrazol-2-yl)methyl)-3,5-difluorobiphenyl-4-yloxy)methyl)piperidin-1-yl)-5-ethylpyrimidine; 2-(4-((4'-((1H-tetrazol-1-yl)methyl)-3,5-difluorobiphenyl-4-yloxy)methyl)piperidin-1-yl)-5-ethylpyrimidine; 5-(4-((1-(5-ethylpyrimidin-2-yl)piperidin-4-yl)methoxy)-3,5-difluorophenyl)picolinamide; 5-(4-((1-(5-ethylpyrimidin-2-yl)piperidin-4-yl)methoxy)-3,5-difluorophenyl)-N-methylpicolinamide; 5-(4-((1-(5-ethylpyrimidin-2-yl)piperidin-4-yl)methoxy)-3,5-difluorophenyl)-N,N-dimethylpicolinamide; 1-methylcyclopropyl 4-((2,6-difluoro-4-(2-(piperazine-1-carbonyl)pyrimidin-5-yl)phenoxy)methyl)piperidine-1-carboxylate; 1-methylcyclopropyl 4-((4-(2-(dimethylcarbamoyl)pyrimidin-5-yl)-2,6-difluorophenoxy)methyl)piperidine-1-carboxylate; 1-methylcyclopropyl 4-((2,6-difluoro-4-(2-(morpholine-4-carbonyl)pyrimidin-5-yl)phenoxy)methyl)piperidine-1-carboxylate; 1-methylcyclopropyl 4-((2,6-difluoro-4-(2-(2-methoxyethylcarbamoyl)pyrimidin-5-yl)phenoxy)methyl)piperidine-1-carboxylate; 1-methylcyclopropyl 4-((2,6-difluoro-4-(2-oxo-2,3-dihydrooxazolo[4,5-b]pyridin-6-yl)phenoxy)methyl)piperidine-1-carboxylate; 1-methylcyclopropyl 4-((2,6-difluoro-4-(2-(2-hydroxyethylcarbamoyl)pyrimidin-5-yl)phenoxy)methyl)piperidine-1-carboxylate; and 1-methylcyclopropyl 4-((2,6-difluoro-4-(2-(3-hydroxypropylcarbamoyl)pyrimidin-5-yl)phenoxy)methyl)piperidine-1-carboxylate, or any of the compounds disclosed in WO 2010/006191, which is incorporated herein by reference in its entirety.

In embodiments wherein Y comprises a structure of Formula J, Y is conjugated to L (e.g. when L is a linking group) or Q (e.g. when L is a bond) at any position of Formula J that is capable of reacting with Q or L. One skilled in the art could readily determine the position of conjugation on Formula J and means of conjugation of Formula J to Q or L in view of general knowledge and the disclosure provided herein. In some embodiments, Formula J is conjugated to L or Q at any of position on Formula J.

GPCR Ligand that Acts at GPR30

In some embodiments of the invention, Y acts at GPR30. In some embodiments, Y can have any structure that permits or promotes agonist activity upon binding to GPR30, while in other embodiments Y is an antagonist of GPR30. In some embodiments, Y acts at GPR30 and is estrogen or a derivative of estrogen, as can be shown by Formula I:

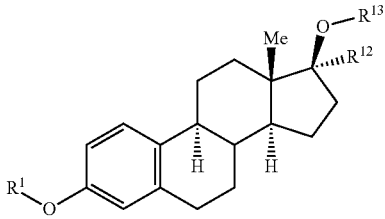

Formula I wherein $R^1$, $R^{12}$ and $R^{13}$ are moieties that permit or promote agonist or antagonist activity upon binding of the compound of Formula I to GPR30. In some embodiments, Formula I further comprises one or more substitutents at one or more of positions 1, 2, 4, 6, 7, 8, 9, 11, 12, 14, 15, and 16 (e.g. a ketone at position-6).

In some embodiments when Y comprises a structure of Formula I, wherein $R^1$ is hydrogen, $C_1$-$C_{18}$ alkyl, $C_2$-$C_{18}$ alkenyl, $C_2$-$C_{18}$ alkynyl, heteroalkyl, ($C_0$-$C_8$ alkyl)aryl, ($C_0$-$C_8$ alkyl)heteroaryl, ($C_0$-$C_8$ alkyl)C(O)$C_1$-$C_{18}$ alkyl, ($C_0$-$C_8$ alkyl)C(O)$C_2$-$C_{18}$ alkenyl, ($C_0$-$C_8$ alkyl)C(O)$C_2$-$C_{18}$ alkynyl, ($C_0$-$C_8$ alkyl)C(O)H, ($C_0$-$C_8$ alkyl)C(O)aryl, ($C_0$-$C_8$ alkyl)C(O)heteroaryl, ($C_0$-$C_8$ alkyl)C(O)O$C_1$-$C_{18}$ alkyl, ($C_0$-$C_8$ alkyl)C(O)O$C_2$-$C_{18}$ alkenyl, ($C_0$-$C_8$ alkyl)C(O)O$C_2$-$C_{18}$ alkynyl, ($C_0$-$C_8$ alkyl)C(O)OH, $C_0$-$C_8$ alkyl)C(O)O aryl, ($C_0$-$C_8$ alkyl)C(O)O heteroaryl, ($C_0$-$C_8$ alkyl)C(O)NR$^{24}C_1$-$C_{18}$ alkyl, ($C_0$-$C_8$ alkyl)C(O)NR$^{24}C_2$-$C_{18}$ alkenyl, ($C_0$-$C_8$ alkyl)C(O)NR$^{24}C_2$-$C_{18}$ alkynyl, ($C_0$-$C_8$ alkyl)C(O)NR$^{24}H_2$, ($C_0$-$C_8$ alkyl)C(O)NR$^{24}$aryl, ($C_0$-$C_8$ alkyl)C(O)NR$^{24}$heteroaryl, or SO$_3$H;

$R^{12}$ is hydrogen, ($C_0$-$C_8$ alkyl)halo, $C_1$-$C_{18}$ alkyl, $C_2$-$C_{18}$ alkenyl, $C_2$-$C_{18}$ alkynyl, heteroalkyl, ($C_0$-$C_8$ alkyl)aryl, ($C_0$-$C_8$ alkyl)heteroaryl, ($C_0$-$C_8$ alkyl)OC$_1$-$C_{18}$ alkyl, ($C_0$-$C_8$ alkyl)OC$_2$-$C_{18}$ alkenyl, ($C_0$-$C_8$ alkyl)OC$_2$-$C_{18}$ alkynyl, ($C_0$-$C_8$ alkyl)OH, ($C_0$-$C_8$ alkyl)SH, ($C_0$-$C_8$ alkyl)NR$^{24}C_1$-$C_{18}$ alkyl, ($C_0$-$C_8$ alkyl)NR$^{24}C_2$-$C_{18}$ alkenyl, ($C_0$-$C_8$ alkyl)NR$^{24}C_2$-$C_{18}$ alkynyl, ($C_0$-$C_8$ alkyl)NR$^{24}H_2$, ($C_0$-$C_8$ alkyl)C(O)$C_1$-$C_{18}$ alkyl, ($C_0$-$C_8$ alkyl)C(O)$C_2$-$C_{18}$ alkenyl, ($C_0$-$C_8$ alkyl)C(O)$C_2$-$C_{18}$ alkynyl, ($C_0$-$C_8$ alkyl)C(O)H, ($C_0$-$C_8$ alkyl)C(O)aryl, ($C_0$-$C_8$ alkyl)C(O)heteroaryl, ($C_0$-$C_8$ alkyl)C(O)OC$_1$-$C_{18}$ alkyl, ($C_0$-$C_8$ alkyl)C(O)OC$_2$-$C_{18}$ alkenyl, ($C_0$-$C_8$ alkyl)C(O)OC$_2$-$C_{18}$ alkynyl, ($C_0$-$C_8$ alkyl)C(O)OH, ($C_0$-$C_8$ alkyl)C(O)O aryl, ($C_0$-$C_8$ alkyl)C(O)O heteroaryl, ($C_0$-$C_8$ alkyl)OC(O)$C_1$-$C_{18}$ alkyl, ($C_0$-$C_8$ alkyl)OC(O)$C_2$-$C_{18}$ alkenyl, ($C_0$-$C_8$ alkyl)OC(O)$C_2$-$C_{18}$ alkynyl, ($C_0$-$C_8$ alkyl)C(O)NR$^{24}C_1$-$C_{18}$ alkyl, ($C_0$-$C_8$ alkyl)C(O)NR$^{24}C_2$-$C_{18}$ alkenyl, ($C_0$-$C_8$ alkyl)C(O)NR$^{24}C_2$-$C_{18}$ alkynyl, ($C_0$-$C_8$ alkyl)C(O)NR$^{24}H_2$, ($C_0$-$C_8$ alkyl)C(O)NR$^{24}$aryl, ($C_0$-$C_8$ alkyl)C(O)NR$^{24}$heteroaryl, ($C_0$-$C_8$ alkyl)NR$^{24}C(O)C_1$-$C_{18}$ alkyl, ($C_0$-$C_8$alkyl)NR$^{24}C(O)C_2$-$C_8$ alkenyl, or ($C_0$-$C_8$ alkyl)NR$^{24}C(O)C_2$-$C_{18}$ alkynyl, ($C_0$-$C_8$ alkyl)NR$^{24}C(O)OH$, ($C_0$-$C_8$ alkyl)OC(O)OC$_1$-$C_{18}$ alkyl, ($C_0$-$C_8$ alkyl)OC(O)OC$_2$-$C_{18}$ alkenyl, ($C_0$-$C_8$ alkyl)OC(O)OC$_2$-$C_{18}$ alkynyl, ($C_0$-$C_8$ alkyl)OC(O)OH, ($C_0$-$C_8$ alkyl)OC(O)NR$^{24}C_1$-$C_{18}$ alkyl, ($C_0$-$C_8$ alkyl)OC(O)NR$^{24}C_2$-$C_{18}$ alkenyl, ($C_0$-$C_8$ alkyl)OC(O)NR$^{24}C_2$-$C_{18}$ alkynyl, ($C_0$-$C_8$ alkyl)OC(O)NR$^{24}H_2$, ($C_0$-$C_8$ alkyl)NR$^{24}(O)OC_1$-$C_{18}$ alkyl, ($C_0$-$C_8$ alkyl)NR$^{24}(O)OC_2$-$C_{18}$ alkenyl, ($C_0$-$C_8$ alkyl)NR$^{24}(O)OC_2$-$C_{18}$ alkynyl, or ($C_0$-$C_8$ alkyl)NR$^{24}(O)OH$; ($C_0$-$C_8$ alkyl)C(O)$C_1$-$C_{18}$ alkyl, ($C_0$-$C_8$ alkyl)C(O)$C_2$-$C_{18}$ alkenyl, ($C_0$-$C_8$ alkyl)C(O)$C_2$-$C_{18}$ alkynyl, ($C_0$-$C_8$ alkyl)C(O)OC$_1$-$C_{18}$ alkyl, ($C_0$-$C_8$ alkyl)C(O)OC$_2$-$C_{18}$ alkenyl, ($C_0$-$C_8$ alkyl)C(O)OC$_2$-$C_{18}$ alkynyl, ($C_0$-$C_8$ alkyl)C(O)OH, ($C_0$-$C_8$ alkyl)OC(O)$C_1$-$C_{18}$ alkyl, ($C_0$-$C_8$ alkyl)OC(O)$C_2$-$C_{18}$ alkenyl, ($C_0$-$C_8$ alkyl)OC(O)$C_2$-$C_{18}$ alkynyl, ($C_0$-$C_8$ alkyl)C(O)NR$^{24}C_1$-$C_{18}$ alkyl, ($C_0$-$C_8$ alkyl)C(O)NR$^{24}C_2$-$C_{18}$ alkenyl, ($C_0$-$C_8$ alkyl)C(O)NR$^{24}C_2$-$C_{18}$ alkynyl, ($C_0$-$C_8$ alkyl)C(O)NR$^{24}H_2$, ($C_0$-$C_8$ alkyl)NR$^{24}C(O)C_1$-$C_{18}$ alkyl, ($C_0$-$C_8$ alkyl)NR$^{24}C(O)C_2$-$C_8$ alkenyl, or ($C_0$-$C_8$ alkyl)NR$^{24}C(O)C_2$-$C_{18}$ alkynyl, or ($C_0$-$C_8$ alkyl)NR$^{24}C(O)OH$;

$R^{13}$ is hydrogen, $C_1$-$C_{18}$ alkyl, $C_2$-$C_{18}$ alkenyl, $C_2$-$C_{18}$ alkynyl, heteroalkyl, ($C_0$-$C_8$ alkyl)aryl, ($C_0$-$C_8$ alkyl)heteroaryl, ($C_0$-$C_8$ alkyl)C(O)$C_1$-$C_{18}$ alkyl, ($C_0$-$C_8$ alkyl)C(O)$C_2$-$C_{18}$ alkenyl, ($C_0$-$C_8$ alkyl)C(O)$C_2$-$C_{18}$ alkynyl, ($C_0$-$C_8$ alkyl)C(O)H, ($C_0$-$C_8$ alkyl)C(O)aryl, ($C_0$-$C_8$ alkyl)C(O)heteroaryl, ($C_0$-$C_8$ alkyl)C(O)OC$_1$-$C_{18}$ alkyl, ($C_0$-$C_8$ alkyl)C(O)OC$_2$-$C_{18}$ alkenyl, ($C_0$-$C_8$ alkyl)C(O)OC$_2$-$C_{18}$ alkynyl, ($C_0$-$C_8$ alkyl)C(O)OH, $C_0$-$C_8$ alkyl)C(O)O aryl, ($C_0$-$C_8$ alkyl)C(O)O heteroaryl, ($C_0$-$C_8$ alkyl)C(O)NR$^{24}C_1$-$C_{18}$ alkyl, ($C_0$-$C_8$ alkyl)C(O)NR$^{24}C_2$-$C_{18}$ alkenyl, ($C_0$-$C_8$ alkyl)C(O)NR$^{24}C_2$-$C_{18}$ alkynyl, ($C_0$-$C_8$ alkyl)C(O)NR$^{24}H_2$, ($C_0$-$C_8$ alkyl)C(O)NR$^{24}$aryl, ($C_0$-$C_8$ alkyl)C(O)NR$^{24}$heteroaryl, or SO$_3$H; and, $R^{24}$ is hydrogen or $C_1$-$C_{18}$ alkyl.

In some embodiments, Y acts at GPR30 and comprises a structure of Formula I, wherein $R^1$ is hydrogen, $C_1$-$C_7$ alkyl; ($C_0$-$C_3$ alkyl)C(O)$C_1$-$C_7$ alkyl, ($C_0$-$C_3$ alkyl)C(O)aryl, or SO$_3$H;

$R^{12}$ is hydrogen, ($C_0$-$C_8$ alkyl)halo, $C_1$-$C_8$ alkyl, $C_2$-$C_8$ alkenyl, $C_{2\text{-}18}$ alkynyl, heteroalkyl, ($C_0$-$C_8$ alkyl)aryl, ($C_0$-$C_8$ alkyl)heteroaryl, ($C_0$-$C_8$ alkyl)OC$_1$-$C_8$ alkyl, ($C_0$-$C_8$ alkyl)OC$_2$-$C_8$ alkenyl, ($C_0$-$C_8$ alkyl)OC$_2$-$C_8$ alkynyl, ($C_0$-$C_8$ alkyl)OH, ($C_0$-$C_8$ alkyl)SH, ($C_0$-$C_8$ alkyl)NR$^{24}C_1$-$C_8$ alkyl, ($C_0$-$C_8$ alkyl)NR$^{24}C_2$-$C_8$ alkenyl, ($C_0$-$C_8$ alkyl)NR$^{24}C_2$-$C_8$ alkynyl, ($C_0$-$C_8$ alkyl)NR$^{24}H_2$, ($C_0$-$C_8$ alkyl)C(O)$C_1$-$C_8$ alkyl, ($C_0$-$C_8$ alkyl)C(O)$C_2$-$C_8$ alkenyl, ($C_0$-$C_8$ alkyl)C(O)$C_2$-$C_8$ alkynyl, ($C_0$-$C_8$ alkyl)C(O)H, ($C_0$-$C_8$ alkyl)C(O)aryl, ($C_0$-$C_8$ alkyl)C(O)heteroaryl, ($C_0$-$C_8$ alkyl)C(O)OC$_1$-$C_8$ alkyl, ($C_0$-$C_8$ alkyl)C(O)OC$_2$-$C_8$ alkenyl, ($C_0$-$C_8$ alkyl)C(O)OC$_2$-$C_8$ alkynyl, ($C_0$-$C_8$ alkyl)C(O)OH, ($C_0$-$C_8$ alkyl)C(O)O aryl, ($C_0$-$C_8$ alkyl)C(O)O heteroaryl, ($C_0$-$C_8$ alkyl)OC(O)$C_1$-$C_8$ alkyl, ($C_0$-$C_8$ alkyl)OC(O)$C_2$-$C_8$ alkenyl, ($C_0$-$C_8$ alkyl)OC(O)$C_2$-$C_{18}$ alkynyl, ($C_0$-$C_8$ alkyl)C(O)NR$^{24}C_1$-$C_8$ alkyl, ($C_0$-$C_8$ alkyl)C(O)NR$^{24}C_2$-$C_8$ alkenyl, ($C_0$-$C_8$ alkyl)C(O)NR$^{24}C_2$-$C_8$ alkynyl, ($C_0$-$C_8$ alkyl)C(O)NR$^{24}H_2$, ($C_0$-$C_8$ alkyl)C(O)NR$^{24}$aryl, ($C_0$-$C_8$ alkyl)C(O)NR$^{24}$heteroaryl, ($C_0$-$C_8$ alkyl)NR$^{24}$C(O)$C_1$-$C_8$ alkyl, ($C_0$-$C_8$ alkyl)NR$^{24}$C(O)$C_2$-$C_8$ alkenyl, or ($C_0$-$C_8$ alkyl)NR$^{24}$C(O)$C_2$-$C_8$ alkynyl, ($C_0$-$C_8$ alkyl)NR$^{24}$C(O)OH, ($C_0$-$C_8$ alkyl)OC(O)O$C_1$-$C_8$ alkyl, ($C_0$-$C_8$ alkyl)OC(O)O$C_2$-$C_8$ alkenyl, ($C_0$-$C_8$ alkyl)OC(O)O$C_2$-$C_8$ alkynyl, ($C_0$-$C_8$ alkyl)OC(O)OH, ($C_0$-$C_8$ alkyl)OC(O)NR$^{24}C_1$-$C_8$ alkyl, ($C_0$-$C_8$ alkyl)OC(O)NR$^{24}C_2$-$C_8$ alkenyl, ($C_0$-$C_8$ alkyl)OC(O)NR$^{24}C_2$-$C_8$ alkynyl, ($C_0$-$C_8$ alkyl)OC(O)NR$^{24}H_2$, ($C_0$-$C_8$ alkyl)NR$^{24}$(O)O$C_1$-$C_8$ alkyl, ($C_0$-$C_8$ alkyl)NR$^{24}$(O)O$C_2$-$C_8$ alkenyl, ($C_0$-$C_8$ alkyl)NR$^{24}$(O)O$C_2$-$C_8$ alkynyl, or ($C_0$-$C_8$ alkyl)NR$^{24}$(O)OH;

$R^{13}$ is hydrogen, $C_1$-$C_8$ alkyl, $C_2$-$C_8$ alkenyl, $C_2$-$C_8$ alkynyl, heteroalkyl, ($C_0$-$C_8$ alkyl)aryl, ($C_0$-$C_8$ alkyl)heteroaryl, ($C_0$-$C_8$ alkyl)C(O)$C_1$-$C_8$ alkyl, ($C_0$-$C_8$ alkyl)C(O)$C_2$-$C_8$ alkenyl, ($C_0$-$C_8$ alkyl)C(O)$C_2$-$C_8$ alkynyl, ($C_0$-$C_8$ alkyl)C(O)H, ($C_0$-$C_8$ alkyl)C(O)aryl, ($C_0$-$C_8$ alkyl)C(O)heteroaryl, ($C_0$-$C_8$ alkyl)C(O)O$C_1$-$C_8$ alkyl, ($C_0$-$C_8$ alkyl)C(O)O$C_2$-$C_8$ alkenyl, ($C_0$-$C_8$ alkyl)C(O)O$C_2$-$C_8$ alkynyl, ($C_0$-$C_8$ alkyl)C(O)OH, $C_0$-$C_8$ alkyl)C(O)O aryl, ($C_0$-$C_8$ alkyl)C(O)O heteroaryl, ($C_0$-$C_8$ alkyl)C(O)NR$^{24}C_1$-$C_8$ alkyl, ($C_0$-$C_8$ alkyl)C(O)NR$^{24}C_2$-$C_8$ alkenyl, ($C_0$-$C_8$ alkyl)C(O)NR$^{24}C_2$-$C_8$ alkynyl, ($C_0$-$C_8$ alkyl)C(O)NR$^{24}H_2$, ($C_0$-$C_8$ alkyl)C(O)NR$^{24}$aryl, or ($C_0$-$C_8$ alkyl)C(O)NR$^{24}$heteroaryl; and $R^{24}$ is hydrogen or $C_1$-$C_7$ alkyl.

For example, $R^1$ is hydrogen, propionate, acetate, benzoate, or sulfate; $R^{12}$ is hydrogen, ethynyl, hydroxyl; and $R^{13}$ is acetate, cypionate, hemisucciniate, enanthate, or propionate.

Nonlimiting examples of the compound of Formula I include 17β-estradiol, modified forms of estradiol such as β-estradiol 17-acetate, β-estradiol 17-cypionate, β-estradiol 17-enanthate, β-estradiol 17-valerate, β-estradiol 3,17-diacetate, β-estradiol 3,17-dipropionate, β-estradiol 3-benzoate, β-estradiol 3-benzoate 17-n-butyrate, β-estradiol 3-glycidyl ether, β-estradiol 3-methyl ether, β-estradiol 6-one, β-estradiol 3-glycidyl, β-estradiol 6-one 6-(O-carboxymethyloxime), 16-epiestriol, 17-epiestriol, 2-methoxy estradiol, 4-methoxy estradiol, estradiol 17-phenylpropionate, and 17β-estradiol 2-methyl ether, 17α-ethynylestradiol, megestrol acetate, estriol, and derivatives thereof. In some embodiments, carbon 17 has a ketone substitutent and $R^5$ and $R^6$ are absent (e.g. estrone). Some of the aforementioned compounds of Formula I are shown below:

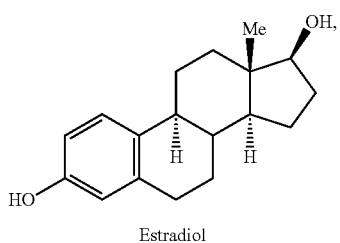

Estradiol

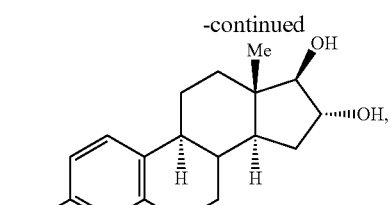

Estriol

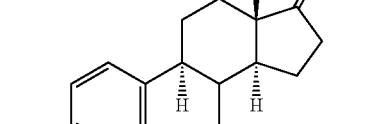

Estrone

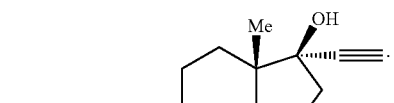

Ethylyl estradiol

Other examples of ligands that act at GPR30 are described in Martensson et al., Endocrinology 150(2):687-698 (2009), which is incorporated herein by reference in its entirety for each of its disclosures of GPR30 ligands.

In embodiments wherein Y comprises a structure of Formula I, Y is conjugated to L (e.g. when L is a linking group) or Q (e.g. when L is a bond) at any position of Formula I that is capable of reacting with Q or L. One skilled in the art could readily determine the position of conjugation on Formula I and means of conjugation of Formula I to Q or L in view of general knowledge and the disclosure provided herein. In some embodiments, Formula I is conjugated to L or Q at any of positions 1, 2, 3, 4, 5, 6, 7, 8, 9, 10, 11, 12, 13, 14, 15, 16, 17, 18, 19, or 20 of Formula I. In some embodiments, Formula B is conjugated to L or Q at position 3 or 17 of Formula I.

GPCR Ligand that Acts at GPR40

In some embodiments of the invention, Y acts at GPR40. In some embodiments, Y can have any structure that permits or promotes agonist activity upon binding to GPR40, while in other embodiments Y is an antagonist of GPR40.

In some embodiments, Y acts at GPR40 and is a free fatty acid or derivative thereof, as shown in Formula B:

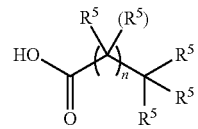

Formula B wherein n is 0-26 and each $R^5$, when present, are each independently a moiety that permits or promotes agonist or antagonist activity upon binding of the compound of Formula B to GPR40. In some embodiments, Y acts at GPR40 and comprises a structure of Formula B, wherein n is 4-26 and each $R^5$, when present, are each independently a moiety that permits or promotes agonist or antagonist activity upon binding of the compound of Formula B to GPR40. In some embodiments, Y acts at GPR40 and comprises a structure of Formula B, wherein n is 4-26 and each $R^5$, when present, is independently hydrogen, $C_1$-$C_7$ alkyl or halogen. Nonlimiting examples of Y is these embodiments include: n-caproic acid, heptanoic acid, caprylic acid, nonanoic acid, capric acid, undecanoic acid, lauric acid, tridecanoic acid, myristic acid, pentadeconoic acid, palmitic acid, heptadecanoic acid, stearic acid, nonadecanoic acid, arachidic acid, heneicosanoic acid, behenic acid, and tricosanoic acid. In some embodiments Y acts at GPR40 and is unsaturated with either cis or trans stereochemistry such as, for example, mead acid, myristoleic acid, palmitoleic acid, sapienic acid, oleic acid, linoleic acid, α-linolenic acid, elaidic acid, retinal, tretinoin, petroselinic acid, arachidonic acid, dihydroxyeicosatetraenoic acid (DiHETE), octadecynoic acid, eicosatriynoic acid, eicosadienoic acid, eicosatrienoic acid, eicosapentaenoic acid, erucic acid, dihomolinolenic acid, docosatrienoic acid, docosapentaenoic acid, docosahexaenoic acid, and adrenic acid. In exemplary embodiments, Y acts at GPR40 and is pentanoic acid, palmitic acid, linoleic acid, or eicosatrienoic acid.

In some embodiments, Y acts at GPR40 and comprises a structure of Formula B further modified with a moiety (e.g. carboxylic acid, carboxylic acid derivative, amide) at its tail. In some embodiments, Y acts at GPR40 and is MEDICA16, as shown below:

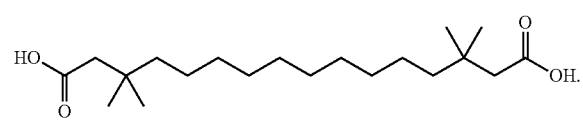 [SMILES: CC(C)(CCCCCCCCCCC(C)(C)CC(=O)O)CC(=O)O]

In embodiments wherein Y comprises a structure of Formula B, Y is conjugated to L (e.g. when L is a linking group) or Q (e.g. when L is a bond) at any position of Formula B that is capable of reacting with Q or L. One skilled in the art could readily determine the position of conjugation on Formula B and means of conjugation of Formula B to Q or L in view of general knowledge and the disclosure provided herein. In some embodiments, Formula B is conjugated to L or Q at any position on Formula B. In some embodiments, Formula B is conjugated to L or Q through the terminal carboxylic acid moiety.

In some embodiments, Y acts at GPR40 and is diacetylphloroglucinol or a derivative thereof, as shown in Formula F:

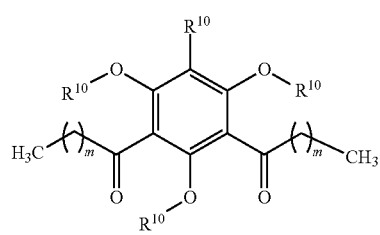

Formula F wherein each m is independently 0-15, and each $R^{10}$ is independently a moiety that permits or promotes agonist or antagonist activity upon binding of the compound of Formula F to GPR40. In some embodiments, Y acts at GPR40 and comprises a structure of Formula F, wherein each m is independently 0-15; and each $R^{10}$ is independently hydrogen or $C_1$-$C_{18}$ alkyl. In some embodiments, Y acts at GPR40 and is a compound of Formula F, wherein each m is 9 and each $R^{10}$ is hydrogen, as shown below:

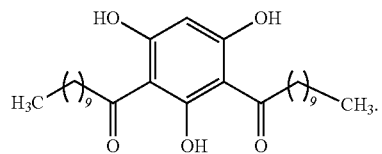

In embodiments wherein Y comprises a structure of Formula F, Y is conjugated to L (e.g. when L is a linking group) or Q (e.g. when L is a bond) at any position of Formula F that is capable of reacting with Q or L. One skilled in the art could readily determine the position of conjugation on Formula F and means of conjugation of Formula F to Q or L in view of general knowledge and the disclosure provided herein. In some embodiments, Formula F is conjugated to L or Q at any position on Formula F. In some embodiments, Formula F is conjugated to L or Q through a hydroxyl moiety.

In some embodiments, Y acts at GPR40 and is retinoic acid or a derivative thereof, as shown in Formula G:

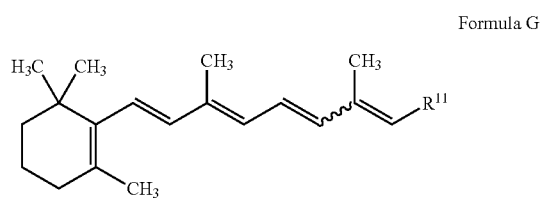

Formula G wherein $R^{11}$ is a moiety that permits or promotes agonist or antagonist activity upon the binding of the compound of Formula G to GPR40, and ∼∼∼ represents either E or Z stereochemistry. In some embodiments, Y acts at GPR40 and comprises a structure of Formula G wherein $R^{11}$ is C(O)OH, $CH_2OH$, or C(O)H. In some embodiments, Y acts at GPR40 and comprises a structure of Formula G wherein $R^{11}$ is a carboxylic acid derivative. Nonlimiting examples of the compound of Formula G include:

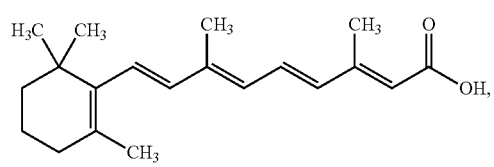

All-trans-retinoic acid

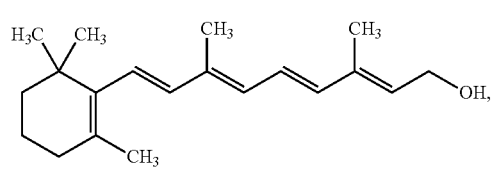

Retinol

-continued

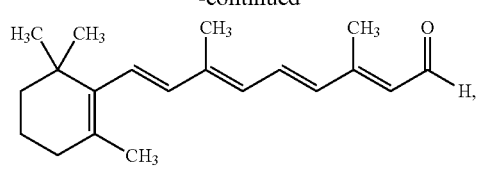

Retinal

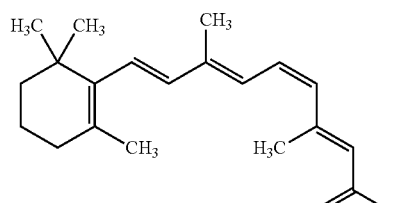

11-cis-retinoic acid and derivatives thereof.

In embodiments wherein Y comprises a structure of Formula G, Y is conjugated to L (e.g. when L is a linking group) or Q (e.g. when L is a bond) at any position of Formula G that is capable of reacting with Q or L. One skilled in the art could readily determine the position of conjugation on Y and means of conjugation of Y to Q or L in view of general knowledge and the disclosure provided herein. In some embodiments, Y is conjugated to L or Q through any position of Y. In some embodiments, Formula G is conjugated to L or Q at $R^{11}$.

In some embodiments, Y acts at GPR40 and is a thiazolidinedione compound comprising a structure as described by Formula H:

Formula H

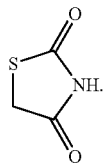

Nonlimiting examples of the compound of Formula H include:

Rosiglitazone

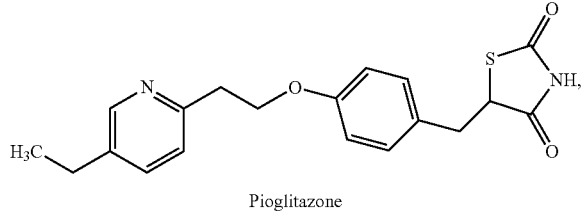

Pioglitazone

-continued

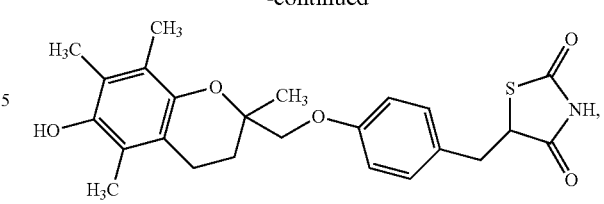

Troglitazone

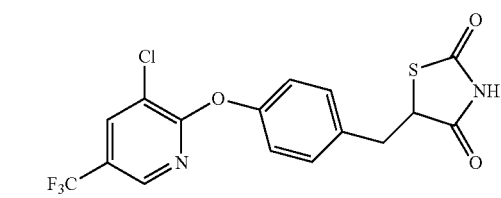

and derivatives thereof.

In embodiments wherein Y comprises a structure of Formula H, Y is conjugated to L (e.g. when L is a linking group) or Q (e.g. when L is a bond) at any position of Formula H that is capable of reacting with Q or L. One skilled in the art could readily determine the position of conjugation on Formula H and means of conjugation of Formula H to Q or L in view of general knowledge and the disclosure provided herein. In some embodiments, Formula H is conjugated to L or Q at any position on Formula H.

In some embodiments, Y is a small molecule having a molecular weight of up to about 5000 daltons, or up to about 2000 daltons, or up to about 1000 daltons, or up to about 500 daltons that permits or promotes agonist or antagonist activity at GPR40. In some embodiments, Y is 1000 daltons or less. Nonlimiting examples of small molecules that permit or promote agonist or antagonist activity at GPR40 include:

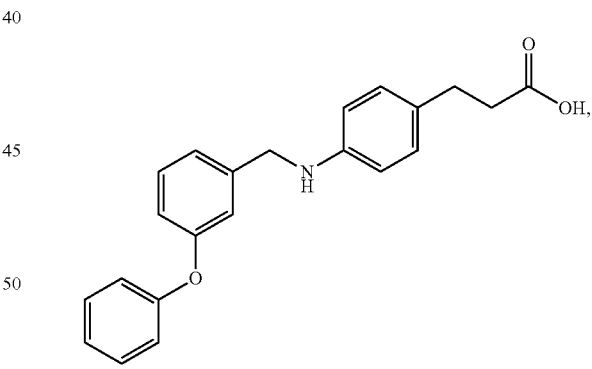

4-(Benzylamino)dihydrocinnamic acid) (GW9508)

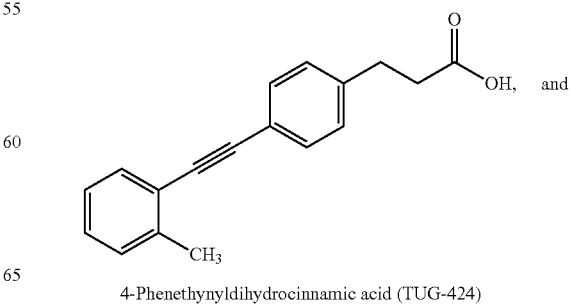

and

4-Phenethynyldihydrocinnamic acid (TUG-424)

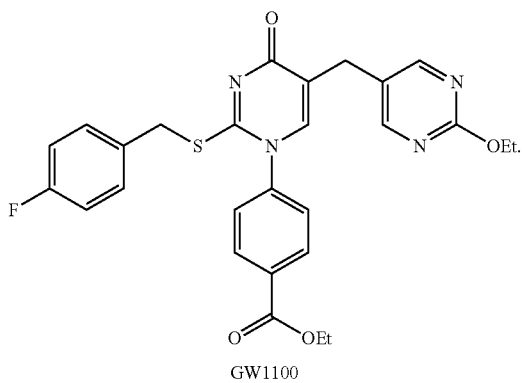

GW1100

In the embodiments wherein Y is a GPCR ligand of low molecular weight, Y is conjugated to L (e.g. when L is a linking group) or Q (e.g. when L is a bond) at any position of Y that is capable of reacting with Q or L. One skilled in the art could readily determine the position of conjugation on Y and means of conjugation of Y to Q or L in view of general knowledge and the disclosure provided herein. In some embodiments, Formula H is conjugated to L or Q through a hydroxyl moiety, through an aromatic moiety, or through a carboxylic acid of Formula H.

In some embodiments, Y is grifolic acid or a derivative thereof, which permits or promotes antagonist activity at GPR40, as shown in Formula E:

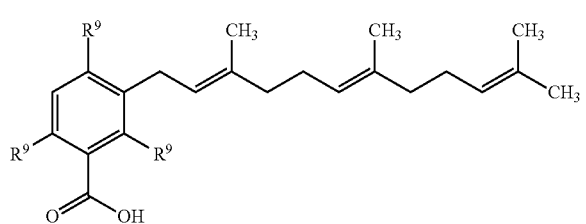

Formula E wherein each $R^9$ is independently a moiety that permits or promotes antagonist activity upon binding of the compound of Formula E to GPR40. In some embodiments, Y acts at GPR40 and comprises a structure of Formula E, wherein each $R^9$ is independently hydrogen, OH, or $O(C_1\text{-}C_8$ alkyl). Non-limiting examples of Y in these embodiments include grifolic acid and grifolic acid methyl ether, shown below:

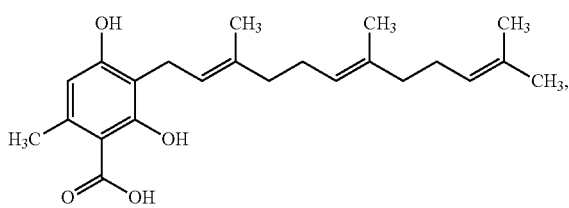

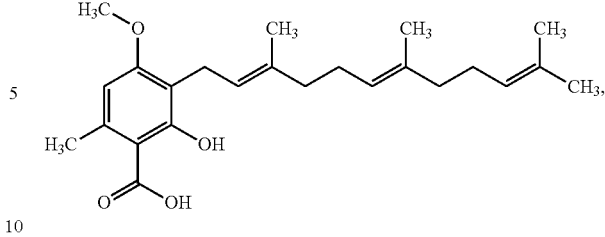

and derivatives thereof.

In embodiments wherein Y comprises a structure of Formula E, Y is conjugated to L (e.g. when L is a linking group) or Q (e.g. when L is a bond) at any position of Formula E that is capable of reacting with Q or L. One skilled in the art could readily determine the position of conjugation on Formula E and means of conjugation of Formula E to Q or L in view of general knowledge and the disclosure provided herein. In some embodiments, Formula E is conjugated to L or Q at any position on Formula E. In some embodiments, Formula E is conjugated to L or Q through a carboxylic acid or hydroxyl moiety.

Other examples of ligands that act at GPR40 are described in Briscoe et al., *J. Biol. Chem.*, 278:11303-11311 (2003); Briscoe et al., Br. J. Pharmacol. 148:619-628 (2006); Davi et al., *Chem. Commun.* 40:4974-4976 (2008); Kebede et al., *Diabetes,* 57:2432-2437 (2008); Hara et al., *Mol. Pharmacol.* 75:85-91 (2009); Hirasawa et al., *Biol. Pharm. Bull.* 31:1847-1851 (2008); Suzuki et al., *J. Med. Chem.* 51:7640-7644 (2008); Tikhonove et al., *J. Med. Chem.* 50:2981-2989 (2007), and Zhou et al. *Bioorg. Med. Chem. Lett.* 18:6357-6361 (2008); each and all of which are incorporated herein by reference for each of their disclosures of GPR40 ligands.

GPCR Ligand that Acts on GPR119

In some embodiments of the invention, Y acts at GPR119. In some embodiments, Y can have any structure that permits or promotes agonist activity upon binding to GPR119, while in other embodiments Y is an antagonist of GPR119.

In some embodiments, Y acts at GPR119 and is a free fatty amide or derivative thereof, as shown in Formula C:

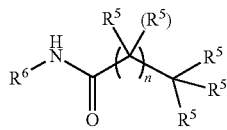

Formula C wherein n is 0-26 and each $R^5$, when present, is independently a moiety that permits or promotes agonist or antagonist activity upon binding of the compound of Formula C to GPR119. In some embodiments, Y acts at GPR119 and comprises a structure of Formula C, wherein n is 0-26; each $R^5$, when present, is independently hydrogen, $C_1\text{-}C_7$ alkyl, or halogen; and $R^6$ is hydrogen, $C_1\text{-}C_{18}$ alkyl, $(C_1\text{-}C_{18}$ alkyl)OH, $(C_1\text{-}C_{18}$ alkyl)NH$_2$, $(C_0\text{-}C_8$ alkyl)halo, $C_2\text{-}C_{18}$ alkenyl, $C_2\text{-}C_{18}$ alkynyl, heteroalkyl, $(C_0\text{-}C_8$ alkyl)aryl, or $(C_0\text{-}C_8$ alkyl)heteroaryl. In some embodiments Formula C is saturated, while is other embodiments, Formula C is unsaturated with either cis or trans stereochemistry.

In some embodiments, Y acts at GPR119 and comprises a structure of Formula C, wherein n is 4-26; each $R^5$, when present, is hydrogen; and $R^6$ is hydrogen. For example, Y acts at GPR119 and is oleamide, as shown below:

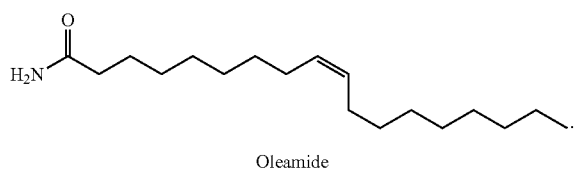 [SMILES: CCCCCCCC/C=C\CCCCCCCC(N)=O]
Oleamide

In some embodiments, Y acts at GPR119 and comprises a structure of Formula C, wherein n is 4-26; each $R^5$, when present, is independently hydrogen or halogen; and $R^6$ is $(C_1-C_8$ alkyl)OH. Nonlimiting examples of compounds of Formula C when $R^6$ is $(C_1-C_8$ alkyl)OH include:

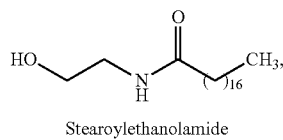
Stearoylethanolamide

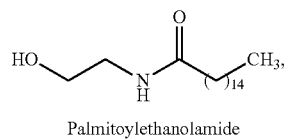
Palmitoylethanolamide

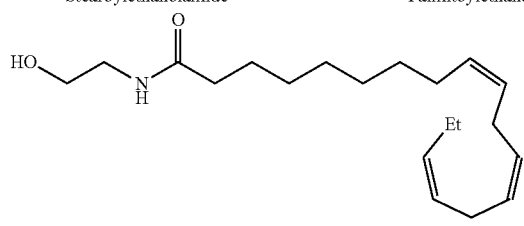
Linolenoyl ethanolamide

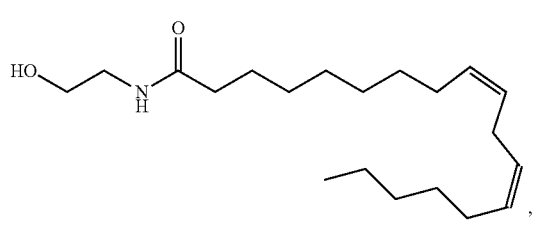
Linoleoyl ethanolamide

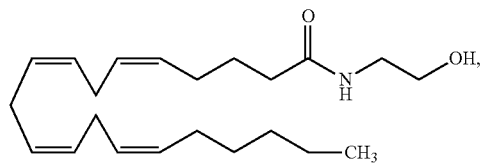
Anandamide

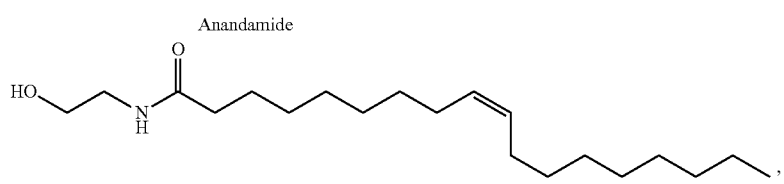
Oleoylethanolamide and derivatives thereof.

In some embodiments, Y acts at GPR119 and comprises a structure of Formula C, wherein n is 4-26; each $R^5$, when present, is independently hydrogen or halogen; and $R^6$ is $(C_1-C_3$ alkyl)aryl. For example, Y acts at GPR119 and is N-oleoyldopamine, as shown below:

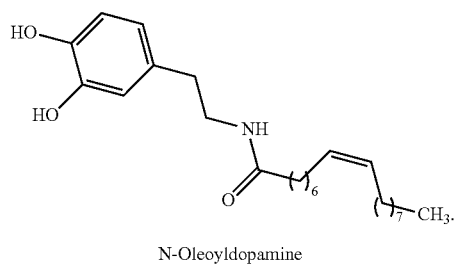
N-Oleoyldopamine

In embodiments wherein Y comprises a structure of Formula C, Y is conjugated to L (e.g. when L is a linking group) or Q (e.g. when L is a bond) at any position of Formula C that is capable of reacting with Q or L. One skilled in the art could readily determine the position of conjugation on Formula C and means of conjugation of Formula C to Q or L in view of general knowledge and the disclosure provided herein. In some embodiments, Formula C is conjugated to L or Q at any position on Formula C. In some embodiments, Formula C is conjugated to L or Q through a terminal carboxylic acid or hydroxyl moiety.

In some embodiments of the invention, Y acts at GPR119 and is a phospholipid or derivative thereof, as shown in Formula D:

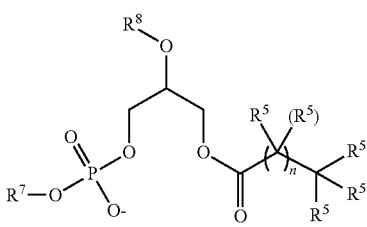
Formula D wherein n is 0-26, each $R^5$, $R^7$, and $R^8$ are moieties that permit or promote agonist or antagonist activity upon binding of the compound of Formula D to GPR119. In some embodiments, Y acts at GPR119 and comprises a structure of Formula D, wherein n is 0-26; each $R^5$, when present, is independently hydrogen, $C_1-C_7$ alkyl, or halogen; $R^7$ is choline, ethanolamine, or inositol; and $R^8$ is hydrogen or

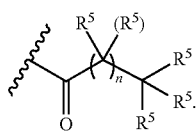

In some embodiments Formula D is saturated, while in other embodiments, Formula D is unsaturated with either cis or trans stereochemistry.

In some embodiments, Y acts at GPR119 and comprises a structure of Formula D, wherein each n is independently 4-26; each $R^5$, when present, is independently hydrogen or halogen; $R^7$ is choline; and $R^8$ is

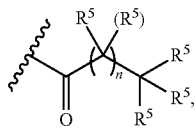

as shown below:

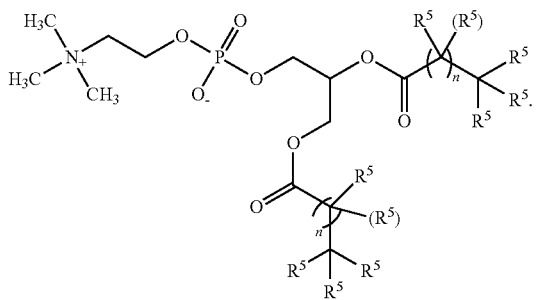

For example, Y acts at GPR119 and is 1-palmitoyl-2-oleo-sn-glycero-3-phosphocholine, as shown below:

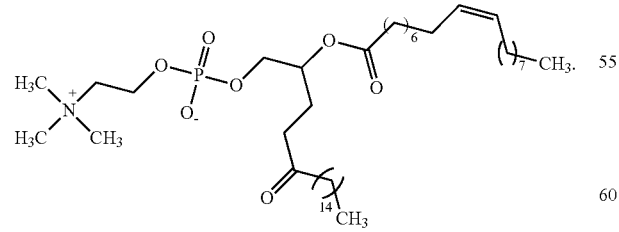

In some embodiments, Y acts at GPR119 and comprises a structure of Formula D, wherein n is 4-26; each $R^5$, when present, is independently hydrogen or halogen; $R^7$ is choline; and $R^8$ is acetyl, as shown below:

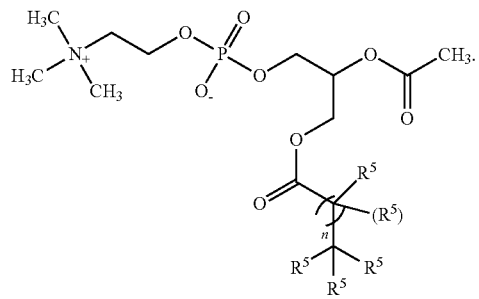

In some embodiments, Y acts at GPR119 and comprises a structure of Formula D, wherein n is 4-26; each $R^5$, when present, is independently hydrogen or halogen; $R^7$ is choline; and $R^8$ is OH, as shown below:

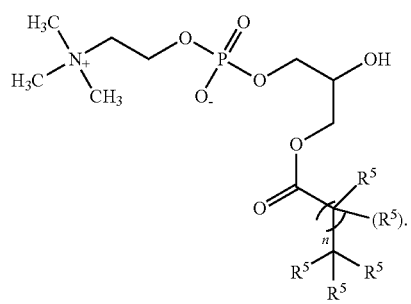

Nonlimiting examples of Y in these embodiments include:

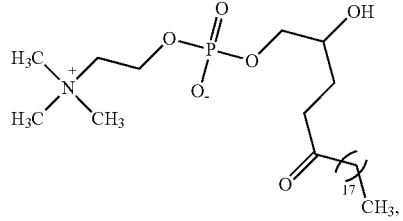

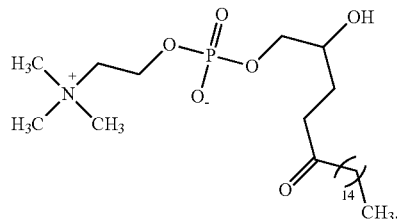

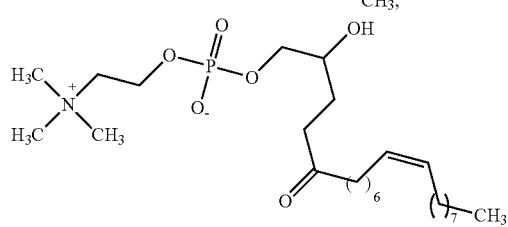

and derivatives thereof.

In some embodiments, Y acts at GPR119 and comprises a structure of Formula D, wherein n is 4-26; each $R^5$, when present, is independently hydrogen or halogen; $R^7$ is ethanolamine, and $R^8$ is OH, as shown below:

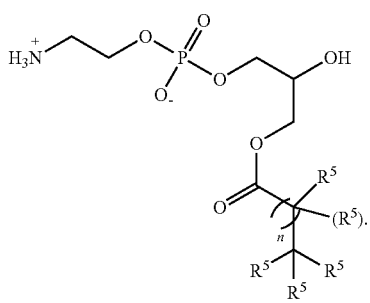

Nonlimiting examples of Y in these embodiments include:

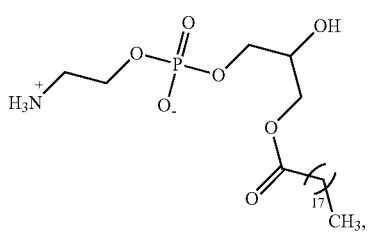

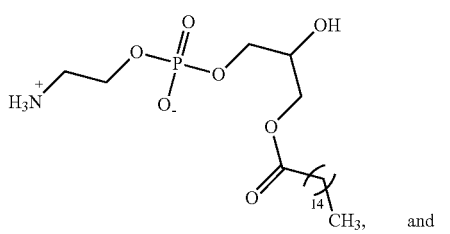

In some embodiments, Y acts at GPR119 and comprises a structure of Formula D, wherein n is 4-26; each $R^5$, when present, is independently hydrogen or halogen; $R^7$ is inositol, and $R^8$ is OH, as shown below:

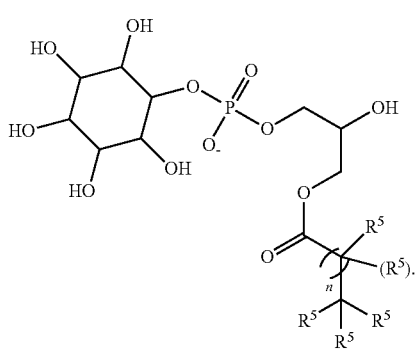

Nonlimiting examples of Y in these embodiments include:

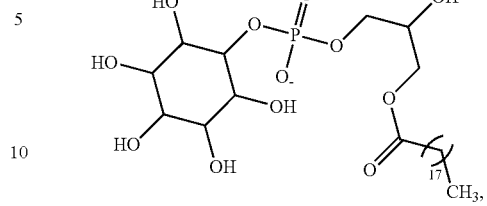

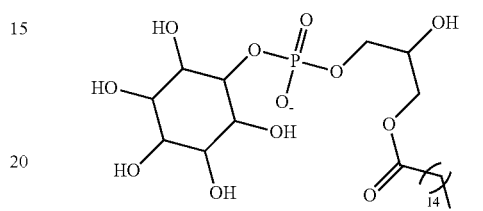

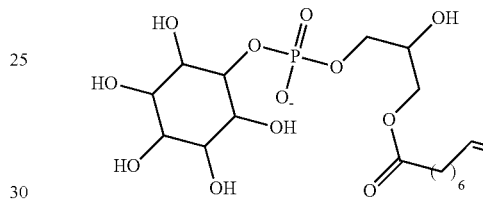

and derivatives thereof.

In embodiments wherein Y comprises a structure of Formula D, Y is conjugated to L (e.g. when L is a linking group) or Q (e.g. when L is a bond) at any position of Formula D that is capable of reacting with Q or L. One skilled in the art could readily determine the position of conjugation on Formula D and means of conjugation of Formula D to Q or L in view of general knowledge and the disclosure provided herein. In some embodiments, Formula D is conjugated to L or Q through a terminal carboxylic acid, amino, or hydroxyl moiety.

In some embodiments, Y acts at GPR119 and is retinoic acid or a derivative thereof, as shown in Formula G:

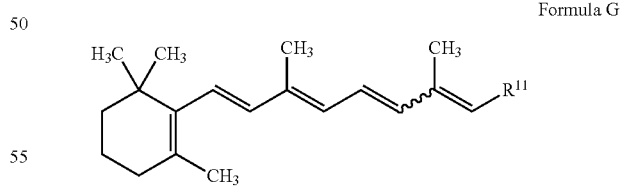

Formula G wherein $R^{11}$ is a moiety that permits or promotes agonist or antagonist activity upon the binding of the compound of Formula G to GPR119, and 〜 represents either E or Z stereochemistry. In some embodiments, Y acts at GPR119 and comprises a structure of Formula G wherein $R^{11}$ is C(O)OH, $CH_2OH$, or C(O)H. In some embodiments, Y acts at GPR119 and comprises a structure of Formula G wherein $R^{11}$ is a carboxylic acid derivative. Nonlimiting examples of the compound of Formula G include:

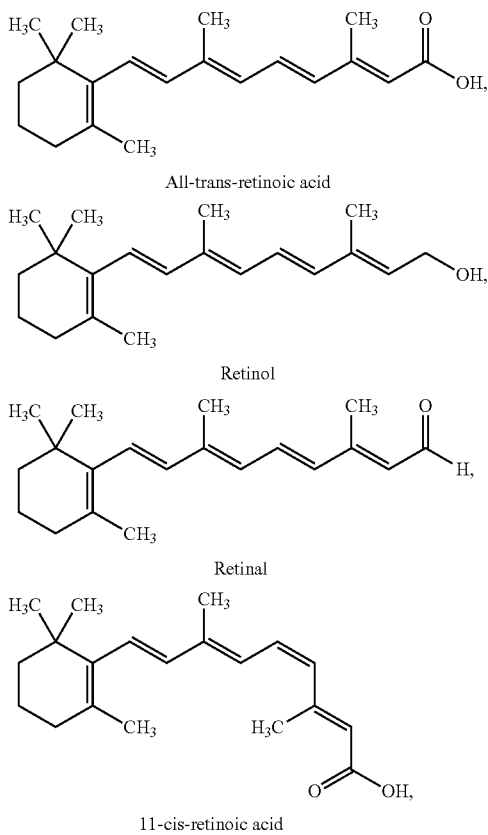

All-trans-retinoic acid

Retinol

Retinal 11-cis-retinoic acid and derivatives thereof. In some embodiments, Y acts at GP119 and is all-trans-retinoic acid.

In embodiments wherein Y comprises a structure of Formula G, Y is conjugated to L (e.g. when L is a linking group) or Q (e.g. when L is a bond) at any position of Formula G that is capable of reacting with Q or L. One skilled in the art could readily determine the position of conjugation on Y and means of conjugation of Y to Q or L in view of general knowledge and the disclosure provided herein. In some embodiments, Y is conjugated to L or Q through any position of Y. In some embodiments, Formula G is conjugated to L or Q at $R^{11}$.

In some embodiments of the invention, Y is small molecule having a molecular weight of up to about 5000 daltons, or up to about 2000 daltons, or up to about 1000 daltons, or up to about 500 daltons that permits or promotes agonist or antagonist activity at GPR119. In some embodiments, Y is 1000 daltons or less. Nonlimiting examples of small molecules that permit or promote agonist or antagonist activity at a GPR119 include:

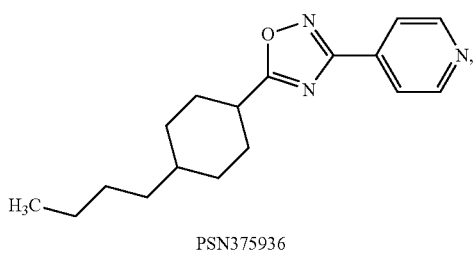

PSN375936

-continued

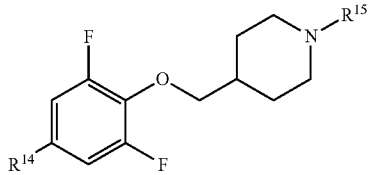

PSN632408 and derivatives thereof.

In the embodiments wherein Y is a GPCR ligand of low molecular weight, Y is conjugated to L (e.g. when L is a linking group) or Q (e.g. when L is a bond) at any position of Y that is capable of reacting with Q or L. One skilled in the art could readily determine the position of conjugation on Y and means of conjugation of Y to Q or L in view of general knowledge and the disclosure provided herein. In some embodiments, Y is conjugated to L or Q through any position of Y, such as, for example, a carboxylic acid or an alcohol moiety.

4-Phenoxymethylpiperidines

In some embodiments of the invention, Y acts at GPR119 and comprises a structure of Formula J:

Formula J

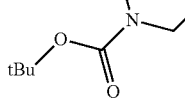

wherein $R^{14}$ and $R^{15}$ are each moieties that permits or promotes agonist or antagonist activity at a GPCR. In some embodiments, Y comprises a structure of Formula J wherein $R^{14}$ is phenyl, pyridin-2-yl, pyridin-3-yl, pyridin-4-yl, pyrimidin-5-yl, pyrazol-4-yl, 1H-pyrazol-4-yl, 6-oxo-1,6-dihydropyridin-3-yl, 2-oxo-1,2-dihydropyrimidin-5-yl, 2-oxo-1,2-dihydropyridin-4-yl and 2-oxo-2,3-dihydrooxazolo[4,5-b]pyridin-6-yl;

wherein said phenyl, pyridin-2-yl, pyridin-3-yl, pyridin-4-yl, pyrimidin-5-yl, pyrazol-4-yl, 1H-pyrazol-4-yl, 6-oxo-1,6-dihydropyridin-3-yl, 2-oxo-1,2-dihydropyrimidin-5-yl, 2-oxo-1,2-dihydropyridin-4-yl or 2-oxo-2,3-dihydrooxazolo[4,5-b]pyridin-6-yl of $R^{14}$ is optionally substituted with 1 to 3 radicals independently selected from halo, $-X^1R^{16}$, $-X^1OR^{16}$, $-X^1C(O)R^{16}$, $-X^1C(O)OR^{16}$, $-X^2NR^{16}C(O)R^{16}$, $-X^1S(O)_2R^{16}$, $-X^1NR^{16}S(O)_2R^{16}$, $-X^1C(O)NR^{16}R^{17}$, $-X^1C(O)NR^{16}X^2OR^{17}$, $-X^1C(O)NR^{16}X^2NR^{16}R^{17}$, $-X^1C(O)NR^{16}X^2C(O)OR^{17}$, $-X^1S(O)O_2X^2R^{16}$, $-X^1S(O)_{0-2}X^2OR^{16}$, $-X^2CN$, $-X^1OX^2R^{16}$, $-X^1NR^{17}X^2R^{16}$, $-X^2NR^{16}R^{17}$, $-X^1S(O)_{0-2}X^2C(O)R^{16}$, $-X^1S(O)_{0-2}X^2C(O)OR^{16}$ and $-X^1S(O)_{0-2}NR^{16}R^{17}$;

wherein $X^1$ is selected from a bond, O, $NR^{17}$ and $C_{1-4}$alkyl;

$R^{17}$ is selected from hydrogen and $C_{1-6}$alkyl;

each $X^2$ is independently selected from a bond and $C_{1-4}$alkyl;

each $R^{16}$ is independently selected from hydrogen, $C_{1-6}$alkyl, $C_{6-10}$aryl, $C_{1-10}$heteroaryl, $C_{3-8}$heterocycloalkyl, $C_{3-8}$cycloalkyl and $-X^3C(O)OR^{18}$, $-X^3R^{18}$, $-X^3OR^{18}$, $-X^3NR^{18}R^{19}$;

wherein said alkyl, aryl, heteroaryl, cycloalkyl and heterocycloalkyl of $R^{16}$ is optionally substituted with 1 to 3 radicals independently selected from hydroxy, halo, amino, cyano, $C_{1-6}$alkyl, halo-substituted-$C_{1-6}$alkyl, hydroxy-substituted-$C_{1-6}$alkyl, $C_{1-6}$alkoxy, halo-substituted-$C_{1-6}$alkoxy, $C_{6-10}$aryl-$C_{1-4}$alkoxy and —$NR^{18}C(O)R^{19}$; $X^3$ is $C_{1-3}$alkyl; and $R^{18}$ is selected from hydrogen, $C_{1-6}$alkyl and $C_{3-8}$heterocycloalkyl optionally substituted with $C_{1-6}$alkyl;

$R^{19}$ are independently selected from hydrogen and $C_{1-6}$alkyl;

and $R^{15}$ is selected from $R^{20}$ and —$C(O)OR^{20}$;

wherein $R^{20}$ is selected from $C_{1-6}$alkyl, $C_{6-10}$aryl, $C_{1-10}$heteroaryl, $C_{3-8}$cycloalkyl and $C_{3-8}$heterocycloalkyl;

wherein said alkyl, aryl, heteroaryl, cycloalkyl or heterocycloalkyl of $R^{20}$ is optionally substituted with 1 to 3 radicals independently selected from halo, $C_{1-6}$alkyl, $C_{3-12}$cycloalkyl, $C_{3-8}$heterocycloalkyl, halo-substituted-$C_{1-6}$alkyl, hydroxy-substituted-$C_{1-6}$alkyl, and halo-substituted-$C_{1-6}$alkoxy; or the pharmaceutically acceptable salts thereof.

Nonlimiting examples of 4-phenoxymethylpiperidine compounds that permit or promote agonist or antagonist activity at a GPCR include: 2-(4-((2,6-difluoro-4-(5-(methylsulfonyl)pyridin-2-yl)phenoxy)methyl)piperidin-1-yl)-5-ethylpyrimidine; tert-butyl 4-((3,5-difluoro-4'-(methylsulfonyl)biphenyl-4-yloxy)methyl)piperidine-1-carboxylate; 2-(4-((3,5-difluoro-4'-(3-methyloxetan-3-yl)methylsulfonyl)biphenyl-4-yloxy)methyl)piperidin-1-yl)-5-ethylpyrimidine; 2-(4((3,5-difluoro-4'-(isobutylsulfonyl)biphenyl-4-yloxy)methyl)piperidin-1-yl)-5-ethylpyrimidine; 2-(4-((3,5-difluoro-4'-(propylsulfonyl)biphenyl-4-yloxy)methyl)piperidin-1-yl)-5-ethylpyrimidine; 2-(4-((3,5-difluoro-4'-(methylsulfonyl)biphenyl-4-yloxy)methyl)piperidin-1-yl)-5-ethylpyrimidine; 2-(44(3,5-difluoro-4'-(isopropylsulfonyl)biphenyl-4-yloxy)methyl)piperidin-1-yl)-5-ethylpyrimidine; 4'-((1-(5-ethylpyrimidin-2-yl)piperidin-4-yl)methoxy)-3',5'-difluorobiphenyl-4-carbonitrile; 4'4(1-(5-ethylpyrimidin-2-yl)piperidin-4-yl)methoxy)-3',5'-difluorobiphenyl-3-carbonitrile; 2-(4'-((1-(5-ethylpyrimidin-2-yl)piperidin-4-yl)methoxy)-3',5'-difluorobiphenyl-3-yl)acetonitrile; (4'4(1-(5-ethylpyrimidin-2-yl)piperidin-4-yl)methoxy)-3',5'-difluorobiphenyl-3-yl)methanol; 2-(4-((3,5-difluoro-3'-(methylsulfonyl)biphenyl-4-yloxy)methyl)piperidin-1-yl)-5-ethylpyrimidine; 2-(4'-((1-(5-ethylpyrimidin-2-yl)piperidin-4-yl)methoxy)-3',5'-difluorobiphenyl-4-yl)acetonitrile; (4'-((1-(5-ethylpyrimidin-2-yl)piperidin-4-yl)methoxy)-3',5'-difluorobiphenyl-4-yl)methanol; 2-(4-((2,6-difluoro-4-(2-(pyrrolidin-1-yl)pyrimidin-5-yl)phenoxy)methyl)piperidin-1-yl)-5-ethylpyrimidine; 2-(4-((2,6-difluoro-4-(pyrimidin-5-yl)phenoxy)methyl)piperidin-1-yl)-5-ethylpyrimidine; 2-(4-((3,5-difluorobiphenyl-4-yloxy)methyl)piperidin-1-yl)-5-ethylpyrimidine; 2-(4-((2,6-difluoro-4-(pyridin-4-yl)phenoxy)methyl)piperidin-1-yl)-5-ethylpyrimidine; tert-butyl 4-((2,6-difluoro-4-(2-methoxypyridin-4-yl)phenoxy)methyl)piperidine-1-carboxylate; tert-butyl 4-((2,6-difluoro-4-(pyridin-4-yl)phenoxy)methyl)piperidine-1-carboxylate; 2-(4-((2,6-difluoro-4-(6-(methylsulfonyl)pyridin-3-yl)phenoxy)methyl)piperidin-1-yl)-5-ethylpyrimidine; 2-(4-((4-(6-chloro-2-methylpyridin-3-yl)-2,6-difluorophenoxy)methyl)piperidin-1-yl)-5-ethylpyrimidine; 2-(4-((2,6-difluoro-4-(1-methyl-1H-pyrazol-4-yl)phenoxy)methyl)piperidin-1-yl)-5-ethylpyrimidine; 2-(4-((2,6-difluoro-4-(1H-pyrazol-4-yl)phenoxy)methyl)piperidin-1-yl)-5-ethylpyrimidine; 5-(4-((1-(5-ethylpyrimidin-2-yl)piperidin-4-yl)methoxy)-3,5-difluorophenyl)picolinonitrile; 2-(4-((2,6-difluoro-4-(3-methoxypyridin-4-yl)phenoxy)methyl)piperidin-1-yl)-5-ethylpyrimidine; N-(4'-((1-(5-ethylpyrimidin-2-yl)piperidin-4-yl)methoxy)-3',5'-difluorobiphenyl-4-yl)acetamide; N-(4'-((1-(5-ethylpyrimidin-2-yl)piperidin-4-yl)methoxy)-3',5'-difluorobiphenyl-4-yl)methanesulfonamide; 2-(4-((4-(6-(benzyloxy)pyridin-3-yl)-2,6-difluorophenoxy)methyl)piperidin-1-yl)-5-ethylpyrimidine; 5-(4-((1-(5-ethylpyrimidin-2-yl)piperidin-4-yl)methoxy)-3,5-difluorophenyl)pyridin-2(1H)-one; 2-(4-((2,6-difluoro-4-(2-methoxypyrimidin-5-yl)phenoxy)methyl)piperidin-1-yl)-5-ethylpyrimidine; 5-(4-((1-(5-ethylpyrimidin-2-yl)piperidin-4-yl)methoxy)-3,5-difluorophenyl)pyrimidin-2(1H)-one; 5-(4-((1-(5-ethylpyrimidin-2-yl)piperidin-4-yl)methoxy)-3,5-difluorophenyl)pyrimidine-2-carboxamide; tert-butyl 4-((2,6-difluoro-4-(pyridin-3-yl)phenoxy)methyl)piperidine-1-carboxylate; 5-(4-((1-(5-ethylpyrimidin-2-yl)piperidin-4-yl)methoxy)-3,5-difluorophenyl)pyrimidine-2-carboxylic acid; 2-(5-(4-((1-(5-ethylpyrimidin-2-yl)piperidin-4-yl)methoxy)-3,5-difluorophenyl)pyridin-2-yl)propan-2-ol; 2-(4-((3,5-difluoro-4'-(1H-tetrazol-5-yl)biphenyl-4-yloxy)methyl)piperidin-1-yl)-5-ethylpyrimidine; 2-(4-((3,5-difluoro-3'-(2H-tetrazol-5-yl)biphenyl-4-yloxy)methyl)piperidin-1-yl)-5-ethylpyrimidine; 2-(4-((3'-((2H-tetrazol-5-yl)methyl)-3,5-difluorobiphenyl-4-yloxy)methyl)piperidin-1-yl)-5-ethylpyrimidine; 2-(4-((4'-((2H-tetrazol-5-yl)methyl)-3,5-difluorobiphenyl-4-yloxy)methyl)piperidin-1-yl)-5-ethylpyrimidine; 2-(4-((4-(6-(2H-tetrazol-5-yl)pyridin-3-yl)-2,6-difluorophenoxy)methyl)piperidin-1-yl)-5-ethylpyrimidine; 2-(4-((3,5-difluoro-4'-(2-methyl-2H-tetrazol-5-yl)biphenyl-4-yloxy)methyl)piperidin-1-yl)-5-ethylpyrimidine; 2-(4-((3,5-difluoro-4'-(1-methyl-1H-tetrazol-5-yl)biphenyl-4-yloxy)methyl)piperidin-1-yl)-5-ethylpyrimidine; 2-(4-((3,5-difluoro-3'-(2-methyl-2H-tetrazol-5-yl)biphenyl-4-yloxy)methyl)piperidin-1-yl)-5-ethylpyrimidine; 2-(4-((3,5-difluoro-3'-(1-methyl-1H-tetrazol-5-yl)biphenyl-4-yloxy)methyl)piperidin-1-yl)-5-ethylpyrimidine; 2-(4-((3,5-difluoro-3'-((2-methyl-2H-tetrazol-5-yl)methyl)biphenyl-4-yloxy)methyl)piperidin-1-yl)-5-ethylpyrimidine; 2-(4-((3,5-difluoro-3'-((1-methyl-1H-tetrazol-5-yl)methyl)biphenyl-4-yloxy)methyl)piperidin-1-yl)-5-ethylpyrimidine; 2-(4-((3,5-difluoro-4'-((2-methyl-2H-tetrazol-5-yl)methyl)biphenyl-4-yloxy)methyl)piperidin-1-yl)-5-ethylpyrimidine; 2-(4-((3,5-difluoro-4'-((1-methyl-1H-tetrazol-5-yl)methyl)biphenyl-4-yloxy)methyl)piperidin-1-yl)-5-ethylpyrimidine; 2-(4-((2,6-difluoro-4-(6-(2-methyl-2H-tetrazol-5-yl)pyridin-3-yl)phenoxy)methyl)piperidin-1-yl)-5-ethylpyrimidine; 2-(4-((2,6-difluoro-4-(6-(1-methyl-1H-tetrazol-5-yl)pyridin-3-yl)phenoxy)methyl)piperidin-1-yl)-5-ethylpyrimidine; 1-methylcyclopropyl 4-((3,5-difluoro-4'-(methylsulfonyl)biphenyl-4-yloxy)methyl)piperidine-1-carboxylate; 4-(4-((1-(tert-butoxycarbonyl)piperidin-4-yl)methoxy)-3,5-difluorophenyl)pyridine 1-oxide; tert-butyl 4-((2,6-difluoro-4-(2-oxo-1,2-dihydropyridin-4-yl)phenoxy)methyl)piperidine-1-carboxylate; tert-butyl 4-((2,6-difluoro-4-(1-methyl-2-oxo-1,2-dihydropyridin-4-yl)phenoxy)methyl)piperidine-1-carboxylate; 2-(4-((2,6-difluoro-4-(2-methyl-6-(1H-1,2,4-triazol-1-yl)pyridin-3-yl)phenoxy)methyl)piperidin-1-yl)-5-ethylpyrimidine; 2-(4-((2,6-difluoro-4-(2-methyl-6-(methylsulfonyl)pyridin-3-yl)phenoxy)methyl)piperidin-1-yl)-5-ethylpyrimidine; 5-(4'-((1-(5-ethylpyrimidin-2-yl)piperidin-4-yl)methoxy)-3',5'-difluorobiphenyl-4-yl)oxazole; 2-(4-((3,5-difluoro-4'-(1H-pyrazol-3-yl)biphenyl-4-yloxy)methyl)piperidin-1-yl)-5-ethylpyrimidine; 1-(4'-((1-(5-ethylpyrimidin-2-yl)piperidin-4-yl)methoxy)-3',5'-difluorobiphenyl-4-yl)-N-methylmethanamine; N-((4'-((1-(5-ethylpyrimidin-2-yl)piperidin-4-yl)methoxy)-3',5'-difluorobiphenyl-4-yl)methyl)-2-methylpropan-2-amine;

44(4'-((1-(5-ethylpyrimidin-2-yl)piperidin-4-yl)methoxy)-3',5'-difluorobiphenyl-4-yl)methyl)morpholino; 2-(4-((4'-((1H-imidazol-1-yl)methyl)-3,5-difluorobiphenyl-4-yloxy)methyl)piperidin-1-yl)-5-ethylpyrimidine; 2-(4-((4'-(2H-tetrazol-2-yl)methyl)-3,5-difluorobiphenyl-4-yloxy)methyl)piperidin-1-yl)-5-ethylpyrimidine; 2-(4-((4'-((1H-tetrazol-1-yl)methyl)-3,5-difluorobiphenyl-4-yloxy)methyl)piperidin-1-yl)-5-ethylpyrimidine; 5-(4-((1-(5-ethylpyrimidin-2-yl)piperidin-4-yl)methoxy)-3,5-difluorophenyl)picolinamide; 5-(4-((1-(5-ethylpyrimidin-2-yl)piperidin-4-yl)methoxy)-3,5-difluorophenyl)-N-methylpicolinamide; 5-(4-((1-(5-ethylpyrimidin-2-yl)piperidin-4-yl)methoxy)-3,5-difluorophenyl)-N,N-dimethylpicolinamide; 1-methylcyclopropyl 4-((2,6-difluoro-4-(2-(piperazine-1-carbonyl)pyrimidin-5-yl)phenoxy)methyl)piperidine-1-carboxylate; 1-methylcyclopropyl 4-((4-(2-(dimethylcarbamoyl)pyrimidin-5-yl)-2,6-difluorophenoxy)methyl)piperidine-1-carboxylate; 1-methylcyclopropyl 4-((2,6-difluoro-4-(2-(morpholine-4-carbonyl)pyrimidin-5-yl)phenoxy)methyl)piperidine-1-carboxylate; 1-methylcyclopropyl 4-((2,6-difluoro-4-(2-(2-methoxyethylcarbamoyl)pyrimidin-5-yl)phenoxy)methyl)piperidine-1-carboxylate; 1-methylcyclopropyl 4-((2,6-difluoro-4-(2-oxo-2,3-dihydrooxazolo[4,5-b]pyridin-6-yl)phenoxy)methyl)piperidine-1-carboxylate; 1-methylcyclopropyl 4-((2,6-difluoro-4-(2-(2-hydroxyethylcarbamoyl)pyrimidin-5-yl)phenoxy)methyl)piperidine-1-carboxylate; and 1-methylcyclopropyl 4-((2,6-difluoro-4-(2-(3-hydroxypropylcarbamoyl)pyrimidin-5-yl)phenoxy)methyl)piperidine-1-carboxylate, or any of the compounds disclosed in WO 2010/006191, which is incorporated herein by reference in its entirety.

In embodiments wherein Y comprises a structure of Formula J, Y is conjugated to L (e.g. when L is a linking group) or Q (e.g. when L is a bond) at any position of Formula J that is capable of reacting with Q or L. One skilled in the art could readily determine the position of conjugation on Formula J and means of conjugation of Formula J to Q or L in view of general knowledge and the disclosure provided herein. In some embodiments, Formula J is conjugated to L or Q at any of position on Formula J.

Other examples of ligands that act at GPR119 are described in Overton et al., *Cell Metabolism* 3:167-175 (2006); Overton et al., *British Journal of Pharmacology* 153:S76-S81 (2008), and WO 2010/006191, each and all of which are incorporated herein by reference for each of its disclosures of GPR119 ligands.

GPCR Ligand that Acts on GPR120

In some embodiments of the invention, Y acts at GPR120. In some embodiments, Y can have any structure that permits or promotes agonist activity upon binding to GPR120, while in other embodiments Y is an antagonist of GPR120.

In some embodiments, Y acts at GPR120 and is an unsaturated free fatty acid or derivative thereof with cis or trans stereochemistry, as shown in Formula B:

Formula B

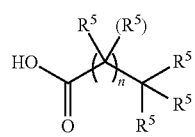

wherein n is 4-26 and each $R^5$, when present, are each independently a moiety that permits or promotes agonist or antagonist activity upon binding of the compound of Formula B to GPR120. In some embodiments, Y acts at GPR120 and comprises a structure of Formula B, wherein n is 4-26 and each $R^5$, when present, is independently hydrogen, $C_1$-$C_7$ alkyl or halogen. Nonlimiting examples of Y is these embodiments include: mead acid, myristoleic acid, palmitoleic acid, sapienic acid, oleic acid, linoleic acid, α-linolenic acid, elaidic acid, petroselinic acid, arachidonic acid, dihydroxyeicosatetraenoic acid (DiHETE), octadecynoic acid, eicosatriynoic acid, eicosadienoic acid, eicosatrienoic acid, eicosapentaenoic acid, erucic acid, dihomolinolenic acid, docosatrienoic acid, docosapentaenoic acid, docosahexaenoic acid, and adrenic acid.

In embodiments wherein Y comprises a structure of Formula B, Y is conjugated to L (e.g. when L is a linking group) or Q (e.g. when L is a bond) at any position of Formula B that is capable of reacting with Q or L. One skilled in the art could readily determine the position of conjugation on Formula B and means of conjugation of Formula B to Q or L in view of general knowledge and the disclosure provided herein. In some embodiments, Formula B is conjugated to L or Q at any position on Formula B. In some embodiments, Formula B is conjugated to L or Q through the terminal carboxylic acid moiety.

In some embodiments, Y acts at GPR120 and is grifolic acid or a derivative thereof, as shown in Formula E:

Formula E

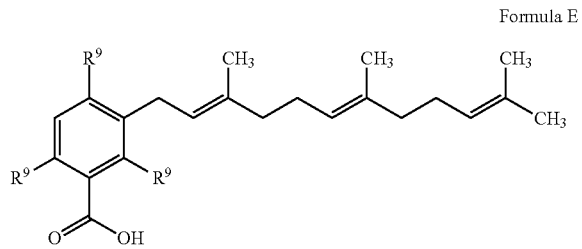

wherein each $R^9$ is independently a functional group that permits or promotes agonist or antagonist activity upon binding of the compound of Formula E to GPR120. In some embodiments, Y acts at GPR120 and comprises a structure of Formula E, wherein each $R^9$ is independently hydrogen, OH, or O($C_1$-$C_8$ alkyl). Nonlimiting examples of Y in these embodiments include grifolic acid and grifolic acid methyl ether, shown below:

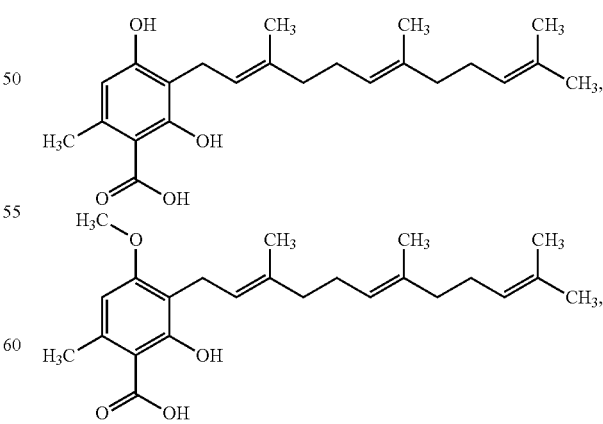

and derivatives thereof.

In embodiments wherein Y comprises a structure of Formula E, Y is conjugated to L (e.g. when L is a linking group)

or Q (e.g. when L is a bond) at any position of Formula E that is capable of reacting with Q or L. One skilled in the art could readily determine the position of conjugation on Formula E and means of conjugation of Formula E to Q or L in view of general knowledge and the disclosure provided herein. In some embodiments, Formula E is conjugated to L or Q at any position on Formula E. In some embodiments, Formula E is conjugated to L or Q through a carboxylic acid or hydroxyl moiety.

In some embodiments, Y is a small molecule having a molecular weight of up to about 5000 daltons, or up to about 2000 daltons, or up to about 1000 daltons, or up to about 500 daltons that permits or promotes agonist or antagonist activity at GPR120. In some embodiments, Y is 1000 daltons or less. For example Y acts at GPR120 and is GW9508, as shown below:

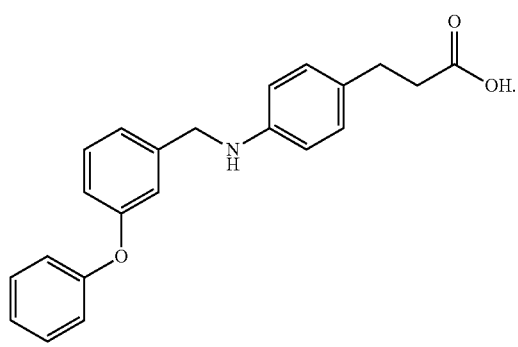

4-(Benzylamino)dihydrocinnamic acid) (GW9508)

In the embodiments wherein Y is a GPCR ligand of low molecular weight, Y is conjugated to L (e.g. when L is a linking group) or Q (e.g. when L is a bond) at any position of Y that is capable of reacting with Q or L. One skilled in the art could readily determine the position of conjugation on Y and means of conjugation of Y to Q or L in view of general knowledge and the disclosure provided herein. In some embodiments, Y is conjugated to L or Q through any position of Y.

Other examples of ligands that act at GPR120 are described in; Briscoe et al., *Br. J. Pharmacol.* 148:619-628 (2006); Hara et al., *Mol. Pharmacol.* 75:85-91 (2009); and Hirasawa et al., *Biol. Pharm. Bull.* 31:1847-1851 (2008), each and all of which are incorporated herein by reference for each of their disclosures of GPR120 ligands.

Modification of the GPCR Ligand (Y)

In some embodiments, the GPCR ligand is derivatized or otherwise chemically modified to comprise a reactive functional group that is capable of reacting with the glucagon superfamily peptide (Q) or the linking group (L). In the embodiments described herein, Y is derivatized at any position of Y that is capable of reacting with Q or L. The position of derivatization on Y is apparent to one skilled in the art and depends on the type of GPCR ligand used and the activity that is desired. In some embodiments, Y is derivatized at any of positions 1, 2, 3, 4, 5, 6, 7, 8, 9, 10, 11, 12, 13, 14, 15, 16, 17, 18, 19, 20, 21, 22, 23, 24, or 25. Other positions of derivatization can be as previously described herein The GPCR ligand can be derivatized using any agent known to one skilled in the art or described herein (e.g. see *The Linking Group* section and the *Chemical Modification of Q and/or Y* subsection). For example, estradiol can be derivatized with succinic acid, succinic anhydride, benzoic acid, ethyl 2-bromoacetate, or iodoacetic acid to form the below derivatives of estradiol that are capable of conjugating to Q or L.

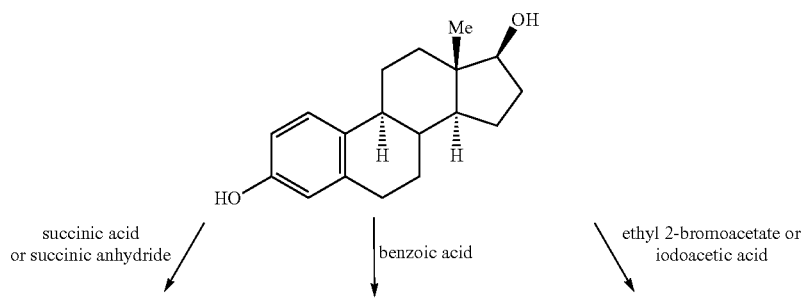

-continued

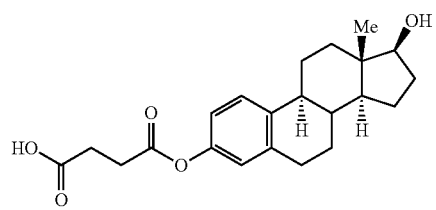

or

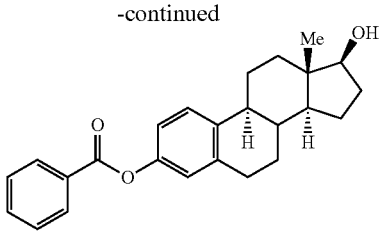

or

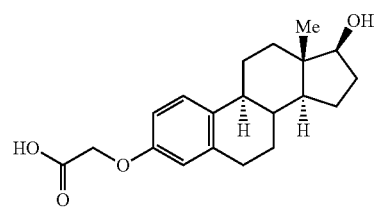

or

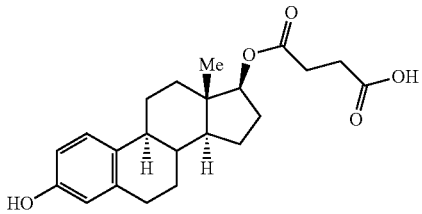

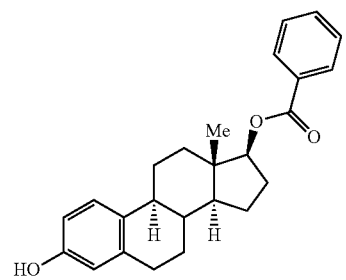

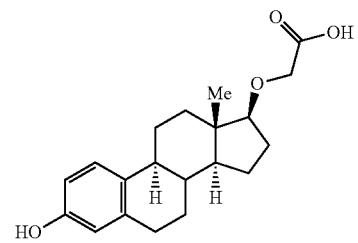

Similarly, any of the aforementioned GPCR ligands can be derivatized by methods known in the art. Additionally, certain derivatized ligands are commercially available and can be purchased from chemical companies such as Sigma-Aldrich.

The Glucagon Superfamily Peptide (O)

In the Q-L-Y conjugates described herein, Q is a glucagon superfamily peptide. A glucagon superfamily peptide refers to a group of peptides related in structure in their N-terminal and/or C-terminal regions (see, for example, Sherwood et al., *Endocrine Reviews* 21: 619-670 (2000)). It is believed that the C-terminus generally functions in receptor binding and the N-terminus generally functions in receptor signaling. A few amino acids in the N-terminal and C-terminal regions are highly conserved among members of the glucagon superfamily. Some of these conserved amino acids include Hist, Gly4, Phe6, Phe22, Val23, Trp25 and Leu26, with amino acids at these positions showing identity, conservative substitutions or similarity in the structure of their amino acid side chains.

Glucagon superfamily peptides include glucagon related peptides, Growth Hormone Releasing Hormone (GHRH; SEQ ID NO: 1619), vasoactive intestinal peptide (VIP; SEQ ID NO: 1620), pituitary adenylate cyclase-activating polypeptide 27 (PACAP-27; SEQ ID NO: 1621), peptide histidine isoleucine (PHI; SEQ ID NO: 1542), peptide histidine methionine (PHM; SEQ ID NO: 1622), secretin (SEQ ID NO: 1623), and/or analogs, derivatives or conjugates thereof. In some embodiments, Q comprises an amino acid sequence of native glucagon, native exendin-4, native GLP-1(7-37), native GLP-2, native GHRH, native VIP, native PACAP-27, native PHM, native oxyntomodulin, native secretin, or native GIP with up to 1, 2, 3, 4, 5, 6, 7, 8, 9 or 10 amino acid modifications.

In some aspects of this invention, Q is a glucagon related peptide such as, for example, glucagon (SEQ ID NO: 1601), oxyntomodulin (SEQ ID NO: 1606), exendin-4 (SEQ ID NO: 1618), glucagon-like peptide-1 (GLP-1) (amino acids 7-36 provided as SEQ ID NO: 1603; amino acids 7-37 are provided as SEQ ID NO: 1604), glucagon-like peptide-2 (GLP-2, SEQ ID NO: 1608), gastric inhibitory peptide (GIP, SEQ ID NO: 1607) or analogs, derivatives and conjugates thereof. A glucagon related peptide has biological activity (as an agonist or antagonist) at any one or more of the glucagon, GLP-1, GLP-2, and GIP receptors and comprise an amino acid sequence that shares at least 20% sequence identity (e.g., 25%, 30%, 35%, 40%, 45%, 50%, 55%, 60%, 65%, 70%, 75%, 80%, 85%, 90%, 95%) with at least one of native glucagon, native oxyntomodulin, native exendin-4, native GLP-1(7-37), native GLP-2, or native GIP over the length of the peptide (or over the positions which correspond to glucagon, see e.g. FIG. 1).

It is understood that all possible activity subsets of glucagon related peptides are contemplated, e.g. peptides which have biological activity (as agonists or antagonists) at any one or more of the glucagon or GLP-1 or GIP receptors, together with all possible subsets of sequence identity to each listed native peptide, e.g., comprise an amino acid sequence that shares at least 20%, 25%, 30%, 35%, 40%, 45%, 50%, 55%, 60%, 65%, 70%, 75%, 80%, 85%, 90%, or 95% sequence identity with native GLP-1 over the length of native GLP-1. In some embodiments of the invention, the glucagon related peptide is a peptide having glucagon receptor agonist activity, GLP-1 receptor agonist activity, GIP receptor agonist activity, glucagon receptor/GLP-1 receptor co-agonist activity, glucagon receptor/GIP receptor co-agonist activity, GLP-1 receptor/GIP receptor co-agonist activity, glucagon receptor/GLP-1 receptor/GIP receptor tri-agonist activity, glucagon receptor antagonist activity, or glucagon receptor antagonist/GLP-1 receptor agonist activity. In some embodiments, the peptide retains an alpha-helix conformation in the C-terminal half of the molecule. In some embodiments, the peptide retains positions involved in receptor interaction or signaling, e.g. position 3 of glucagon, or position 7, 10, 12, 13, 15 or 17 of GLP-1(7-37). Accordingly, the glucagon related peptide can be a peptide of Class 1, Class 2, Class 3, Class 4, and/or Class 5, each of which is further described herein.

Q may also be any of the glucagon superfamily peptides that are known in the art, some of which are disclosed herein by way of nonlimiting examples. A variety of GLP-1 analogs are known in the art and are a glucagon-related peptide according to the current invention, see, e.g., WO 2008023050, WO 2007030519, WO 2005058954, WO 2003011892, WO 2007046834, WO 2006134340, WO 2006124529, WO 2004022004, WO 2003018516, WO 2007124461 each incorporated herein by reference in its entirety for each of its sequence or formula disclosures of GLP-1 analogs or derivatives. In any of the embodiments, Q can be a glucagon related peptide disclosed in WO 2007/056362, WO 2008/086086, WO 2009/155527, WO 2008/101017, WO 2009/155258, WO 2009/058662, WO 2009/058734, WO 2009/099763, WO 2010/011439, PCT Patent Application No. US09/68745, and U.S. Patent Application No. 61/187,578 each incorporated herein by reference in its entirety. In certain embodiments, Q is a Class 1, Class 2, Class 3, Class 4, or Class 5 glucagon related peptide as detailed herein. In any of the embodiments described herein, Q is any of SEQ ID NOs: 1-760, 801-919, 1001-1275, 1301-1371, 1401-1518, 1601-1650.

Activity of the Glucagon Superfamily Peptide (Q)

Activity at the Glucagon Receptor

In some embodiments, Q exhibits an $EC_{50}$ for glucagon receptor activation (or an $IC_{50}$ for glucagon receptor antagonism) of about 10 mM or less, or about 1 mM (1000 µM) or less (e.g., about 750 µM or less, about 500 µM or less, about 250 µM or less, about 100 µM or less, about 75 µM or less, about 50 µM or less, about 25 µM or less, about 10 µM or less, about 7.5 µM or less, about 6 µM or less, about 5 µM or less, about 4 µM or less, about 3 µM or less, about 2 µM or less or about 1 µM or less). In some embodiments, Q exhibits an $EC_{50}$ or $IC_{50}$ at the glucagon receptor of about 1000 nM or less (e.g., about 750 nM or less, about 500 nM or less, about 250 nM or less, about 100 nM or less, about 75 nM or less, about 50 nM or less, about 25 nM or less, about 10 nM or less, about 7.5 nM or less, about 6 nM or less, about 5 nM or less, about 4 nM or less, about 3 nM or less, about 2 nM or less or about 1 nM or less). In some embodiments, Q has an $EC_{50}$ or $IC_{50}$ at the glucagon receptor which is in the picomolar range. Accordingly, in some embodiments, Q exhibits an $EC_{50}$ or $IC_{50}$ at the glucagon receptor of about 1000 pM or less (e.g., about 750 pM or less, about 500 pM or less, about 250 pM or less, about 100 pM or less, about 75 pM or less, about 50 pM or less, about 25 pM or less, about 10 pM or less, about 7.5 pM or less, about 6 pM or less, about 5 pM or less, about 4 pM or less, about 3 pM or less, about 2 pM or less or about 1 pM or less).

In some embodiments, Q exhibits an $EC_{50}$ or $IC_{50}$ at the glucagon receptor that is about 0.001 pM or more, about 0.01 pM or more, or about 0.1 pM or more. Glucagon receptor activation (glucagon receptor activity) can be measured by in vitro assays measuring cAMP induction in HEK293 cells over-expressing the glucagon receptor, e.g., assaying HEK293 cells co-transfected with DNA encoding the glucagon receptor and a luciferase gene linked to cAMP responsive element as described in Example 2.

In some embodiments, Q exhibits about 0.001% or more, about 0.01% or more, about 0.1% or more, about 0.5% or more, about 1% or more, about 5% or more, about 10% or more, about 20% or more, about 30% or more, about 40% or more, about 50% or more, about 60% or more, about 75% or more, about 100% or more, about 125% or more, about 150% or more, about 175% or more, about 200% or more, about 250% or more, about 300% or more, about 350% or more, about 400% or more, about 450% or more, or about 500% or higher activity at the glucagon receptor relative to native glucagon (glucagon potency). In some embodiments, Q exhibits about 5000% or less or about 10,000% or less activity at the glucagon receptor relative to native glucagon. The activity of Q at a receptor relative to a native ligand of the receptor is calculated as the inverse ratio of $EC_{50}$s for Q versus the native ligand.

In some embodiments, Q exhibits substantial activity (potency) at only the glucagon receptor and little to no activity at the GLP-1 receptor or the GIP receptor. In some embodiments, Q is considered as a "pure glucagon receptor agonist" or is not considered as a "glucagon/GLP-1 receptor co-agonist" or a "glucagon/GIP receptor co-agonist." In some embodiments Q exhibits any of the levels of activity or potency at the glucagon receptor described herein but has substantially less activity (potency) at the GLP-1 receptor or the GIP receptor. In some embodiments, Q exhibits an $EC_{50}$ at the GLP-1 receptor which is 100-fold or greater than the $EC_{50}$ at the glucagon receptor. In some embodiments, Q exhibits an $EC_{50}$ at the GIP receptor which is 100-fold or greater than the $EC_{50}$ at the glucagon receptor.

Activity at the GLP-1 Receptor

In some embodiments, Q exhibits an $EC_{50}$ for GLP-1 receptor activation (or an $IC_{50}$ for GLP-1 receptor antagonism) of about 10 mM or less, or about 1 mM (1000 µM) or less (e.g., about 750 µM or less, about 500 µM or less, about 250 µM or less, about 100 µM or less, about 75 µM or less, about 50 µM or less, about 25 µM or less, about 10 µM or less, about 7.5 µM or less, about 6 µM or less, about 5 µM or less, about 4 µM or less, about 3 µM or less, about 2 µM or less or about 1 µM or less). In some embodiments, Q exhibits an $EC_{50}$ or $IC_{50}$ for GLP-1 receptor activation of about 1000 nM or less (e.g., about 750 nM or less, about 500 nM or less, about 250 nM or less, about 100 nM or less, about 75 nM or less, about 50 nM or less, about 25 nM or less, about 10 nM or less, about 7.5 nM or less, about 6 nM or less, about 5 nM or less, about 4 nM or less, about 3 nM or less, about 2 nM or less or about 1 nM or less). In some embodiments, Q has an $EC_{50}$ or $IC_{50}$ at the GLP-1 receptor which is in the picomolar range. Accordingly, in some embodiments, Q exhibits an $EC_{50}$ or $IC_{50}$ for GLP-1 receptor activation of about 1000 pM or less (e.g., about 750 pM or less, about 500 pM or less, about 250 pM or less, about 100 pM or less, about 75 pM or less, about 50 pM or less, about 25 pM or less, about 10 pM or less, about 7.5 pM or less, about 6 pM or less, about 5 pM or less, about 4 pM or less, about 3 pM or less, about 2 pM or less or about 1 pM or less).

In some embodiments, Q exhibits an $EC_{50}$ or $IC_{50}$ at the GLP-1 receptor that is about 0.001 pM or more, about 0.01 pM or more, or about 0.1 pM or more. GLP-1 receptor activation (GLP-1 receptor activity) can be measured by in vitro assays measuring cAMP induction in HEK293 cells over-expressing the GLP-1 receptor, e.g., assaying HEK293 cells co-transfected with DNA encoding the GLP-1 receptor and a luciferase gene linked to cAMP responsive element as described in Example 2.

In some embodiments, Q exhibits about 0.001% or more, about 0.01% or more, about 0.1% or more, about 0.5% or more, about 1% or more, about 5% or more, about 10% or more, about 20% or more, about 30% or more, about 40% or more, about 50% or more, about 60% or more, about 75% or more, about 100% or more, about 125% or more, about 150% or more, about 175% or more, about 200% or more, about 250% or more, about 300% or more, about 350% or more, about 400% or more, about 450% or more, or about 500% or higher activity at the GLP-1 receptor relative to native GLP-1 (GLP-1 potency). In some embodiments, Q exhibits about 5000% or less or about 10,000% or less activity at the GLP-1 receptor relative to native GLP-1 (GLP-1 potency).

In some embodiments, Q exhibit substantial activity (potency) at only the GLP-1 receptor and little to no activity at the glucagon receptor or the GIP receptor. In some embodiments, Q is considered as a "pure GLP-1 receptor agonist" or is not considered as a "glucagon/GLP-1 receptor co-agonist" or a "GLP-1/GIP co-agonist." In some embodiments Q exhibits any of the levels of activity or potency at the GLP-1 receptor described herein but have substantially less activity (potency) at the glucagon receptor or the GIP receptor. In some embodiments, Q exhibits an $EC_{50}$ at the glucagon receptor which is 100-fold or greater than the $EC_{50}$ at the GLP-1 receptor. In some embodiments, Q exhibits an $EC_{50}$ at the GIP receptor which is 100-fold or greater than the $EC_{50}$ at the GLP-1 receptor.

Activity at the GIP Receptor

In some embodiments, Q exhibits an $EC_{50}$ for GIP receptor activation (or an $IC_{50}$ for GIP receptor antagonism) of about 10 mM or less, or about 1 mM (1000 µM) or less (e.g., about 750 µM or less, about 500 µM or less, about 250 µM or less, about 100 µM or less, about 75 µM or less, about 50 µM or less, about 25 µM or less, about 10 µM or less, about 7.5 µM or less, about 6 µM or less, about 5 µM or less, about 4 µM or less, about 3 µM or less, about 2 µM or less or about 1 µM or less). In some embodiments, the $EC_{50}$ or $IC_{50}$ of Q at the GIP receptor is less than 1000 nM, less than 900 nM, less than 800 nM, less than 700 nM, less than 600 nM, less than 500 nM, less than 400 nM, less than 300 nM, or less than 200 nM. In some embodiments, the $EC_{50}$ or $IC_{50}$ of Q at the GIP receptor is about 100 nM or less, e.g., about 75 nM or less, about 50 nM or less, about 25 nM or less, about 10 nM or less, about 8 nM or less, about 6 nM or less, about 5 nM or less, about 4 nM or less, about 3 nM or less, about 2 nM or less, or about 1 nM or less. In some embodiments, the Q exhibits an $EC_{50}$ or $IC_{50}$ for GIP receptor activation which is in the picomolar range. In exemplary embodiments, the $EC_{50}$ or $IC_{50}$ of Q at the GIP receptor is less than 1000 pM, less than 900 pM, less than 800 pM, less than 700 pM, less than 600 pM, less than 500 pM, less than 400 pM, less than 300 pM, less than 200 pM. In some embodiments, the $EC_{50}$ or $IC_{50}$ of Q at the GIP receptor is about 100 pM or less, e.g., about 75 pM or less, about 50 pM or less, about 25 pM or less, about 10 pM or less, about 8 pM or less, about 6 pM or less, about 5 pM or less, about 4 pM or less, about 3 pM or less, about 2 pM or less, or about 1 pM or less. Receptor activation can be measured by in vitro assays measuring cAMP induction in HEK293 cells over-expressing the GIP receptor, e.g. assaying HEK293 cells co-transfected with DNA encoding the receptor and a luciferase gene linked to cAMP responsive element as described in Example 2.

In some embodiments of the present disclosures, Q exhibits at least or about 0.1% activity of native GIP at the GIP receptor. In exemplary embodiments, Q exhibits at least or about 0.2%, at least or about 0.3%, at least or about 0.4%, at least or about 0.5%, at least or about 0.6%, at least or about 0.7%, at least or about 0.8%, at least or about 0.9%, at least or about 1%, at least or about 5%, at least or about 10%, at least or about 20%, at least or about 30%, at least or about 40%, at least or about 50%, at least or about 60%, at least or about 70%, at least or about 75%, at least or about 80%, at least or about 90%, at least or about 95%, or at least or about 100% of the activity of native GIP at the GIP receptor.

In some embodiments of the present disclosures, Q exhibits activity at the GIP receptor which is greater than that of native GIP. In exemplary embodiments, Q exhibits at least or about 101%, at least or about 105%, at least or about 110%, at least or about 125%, at least or about 150%, at least or about 175% at least or about 200%, at least or about 300%, at least or about 400%, at least or about 500% or higher % of the activity of native GIP at the GIP receptor. In some embodiments, Q exhibits no more than 1000%, 10,000%, 100,000%, or 1,000,000% activity at the GIP receptor relative to native GIP. A peptide's activity at the GIP receptor relative to native GIP is calculated as the inverse ratio of EC50s for the GIP agonist peptide vs. native GIP.

In some embodiments, Q exhibits substantial activity (potency) at only the GIP receptor and little to no activity at the glucagon receptor or the GLP-1 receptor. In some embodiments, Q is considered as a "pure GIP receptor agonist" or is not considered as a "glucagon/GIP receptor co-agonist" or a "GLP-1/GIP co-agonist." In some embodiments Q exhibits any of the levels of activity or potency at the GIP receptor described herein but has substantially less activity (potency) at the glucagon receptor or the GLP-1 receptor. In some embodiments, Q exhibits an $EC_{50}$ at the glucagon receptor which is 100-fold or greater than the $EC_{50}$ at the GIP receptor and an $EC_{50}$ at the GLP-1 receptor which is 100-fold or greater than the $EC_{50}$ at the GIP receptor.

Activity at the GLP-1 Receptor and the Glucagon Receptor

In some embodiments, Q exhibits activity at both the GLP-1 receptor and glucagon receptor ("glucagon/GLP-1 receptor co-agonists"). In some embodiments, the activity (e.g., the $EC_{50}$ or the relative activity or potency) of Q at the glucagon receptor is within about 50-fold, about 40-fold, about 30-fold, about 20-fold, about 10-fold, or about 5 fold different (higher or lower) from its activity (e.g., the $EC_{50}$ or the relative activity or potency) at the GLP-1 receptor. In some embodiments, the glucagon potency of Q is within about 25-, about 20-, about 15-, about 10-, or about 5-fold different (higher or lower) from its GLP-1 potency.

In some embodiments, the ratio of the relative activity or the $EC_{50}$ or the potency of the Q at the glucagon receptor divided by the relative activity or the $EC_{50}$ or potency of Q at the GLP-1 receptor is less than, or is about, X, wherein X is selected from 100, 75, 60, 50, 40, 30, 20, 15, 10, or 5. In some embodiments, the ratio of the $EC_{50}$ or potency or relative activity of Q at the glucagon receptor divided by the $EC_{50}$ or potency or relative activity of Q at the GLP-1 receptor is about 1 less than 5 (e.g., about 4, about 3, about 2, about 1). In some embodiments, the ratio of the glucagon potency of Q compared to the GLP-1 potency of Q is less than, or is about, Z, wherein Z is selected from 100, 75, 60, 50, 40, 30, 20, 15, 10, and 5. In some embodiments, the ratio of the glucagon potency of Q compared to the GLP-1 potency of Q is less than 5 (e.g., about 4, about 3, about 2, about 1). In some embodiments, Q has an $EC_{50}$ at the glucagon receptor which is 2- to 10-fold (e.g., 2-fold, 3-fold, 4-fold, 5-fold, 6-fold, 7-fold, 8-fold, 9-fold, 10-fold) greater than the $EC_{50}$ at the GLP-1 receptor.

In some embodiments, the ratio of the relative activity or potency or the $EC_{50}$ of Q at the GLP-1 receptor divided by the relative activity or potency or the $EC_{50}$ of the glucagon analog at the glucagon receptor is less than, or is about, V, wherein V is selected from 100, 75, 60, 50, 40, 30, 20, 15, 10, or 5. In some embodiments, the ratio of the $EC_{50}$ or potency or relative activity of Q at the GLP-1 receptor divided by the $EC_{50}$ or potency or relative activity of Q at the glucagon receptor is less than 5 (e.g., about 4, about 3, about 2, about 1). In some embodiments, the ratio of the GLP-1 potency of Q compared to the glucagon potency of Q is less than, or is about, W, wherein W is selected from 100, 75, 60, 50, 40, 30, 20, 15, 10, and 5. In some embodiments, the ratio of the GLP-1 potency of Q compared to the glucagon potency of Q is less than 5 (e.g., about 4, about 3, about 2, about 1). In some embodiments, Q has an $EC_{50}$ at the GLP-1 receptor which is about 2- to about 10-fold (e.g., 2-fold, 3-fold, 4-fold, 5-fold, 6-fold, 7-fold, 8-fold, 9-fold, 10-fold) greater than the $EC_{50}$ at the glucagon receptor.

In some embodiments, Q exhibits at least 0.1% (e.g., about 0.5% or more, about 1% or more, about 5% or more, about 10% or more, or more) of the activity of native GLP-1 at the GLP-1 receptor (GLP-1 potency) and exhibits at least 0.1% (e.g., about 0.5% or more, about 1% or more, about 5% or more, about 10% or more, or more) of the activity of native glucagon at the glucagon receptor (glucagon potency).

Selectivity of Q for the glucagon receptor versus the GLP-1 receptor can be described as the relative ratio of glucagon/GLP-1 activity (Q's activity at the glucagon receptor relative to native glucagon, divided by the analog's activity at the GLP-1 receptor relative to native GLP-1). For example, a Q that exhibits 60% of the activity of native glucagon at the glucagon receptor and 60% of the activity of native GLP-1 at the GLP-1 receptor has a 1:1 ratio of glucagon/GLP-1 activity. Exemplary ratios of glucagon/GLP-1 activity include about 1:1, 1.5:1, 2:1, 3:1, 4:1, 5:1, 6:1, 7:1, 8:1, 9:1 or 10:1, or about 1:10, 1:9, 1:8, 1:7, 1:6, 1:5, 1:4, 1:3, 1:2, or 1:1.5. As an example, a glucagon/GLP-1 activity ratio of 10:1 indicates a 10-fold selectivity for the glucagon receptor versus the GLP-1 receptor. Similarly, a GLP-1/glucagon activity ratio of 10:1 indicates a 10-fold selectivity for the GLP-1 receptor versus the glucagon receptor.

In some embodiments, Q exhibits substantial activity (potency) at the glucagon receptor and GLP-1 receptor and little to no activity at the GIP receptor. In some embodiments Q exhibits any of the levels of activity or potency at the glucagon receptor and the GLP-1 receptor described herein but has substantially less activity (potency) at the GIP receptor. In some embodiments, Q exhibits an $EC_{50}$ at the GIP receptor which is 100-fold or greater than the $EC_{50}$ at the glucagon receptor and the $EC_{50}$ at the GLP-1 receptor.

Activity at the GLP-1 Receptor and the GIP Receptor

In some embodiments, Q exhibits activity at both the GLP-1 receptor and GIP receptor ("GIP/GLP-1 receptor co-agonists"). In some embodiments, the activity (e.g., the $EC_{50}$ or the relative activity or potency) of Q at the GIP receptor is within about 50-fold, about 40-fold, about 30-fold, about 20-fold, about 10-fold, or about 5 fold different (higher or lower) from its activity (e.g., the $EC_{50}$ or the relative activity or potency) at the GLP-1 receptor. In some embodiments, the GIP potency of Q is within about 25-, about 20-, about 15-, about 10-, or about 5-fold different (higher or lower) from its GLP-1 potency.

In some embodiments, the ratio of the relative activity or the $EC_{50}$ or the potency of the Q at the GIP receptor divided by the relative activity or the $EC_{50}$ or potency of Q at the GLP-1 receptor is less than, or is about, X, wherein X is selected from 100, 75, 60, 50, 40, 30, 20, 15, 10, or 5. In some embodiments, the ratio of the $EC_{50}$ or potency or relative activity of Q at the GIP receptor divided by the $EC_{50}$ or potency or relative activity of Q at the GLP-1 receptor is about 1 less than 5 (e.g., about 4, about 3, about 2, about 1). In some embodiments, the ratio of the GIP potency of Q compared to the GLP-1 potency of Q is less than, or is about, Z, wherein Z is selected from 100, 75, 60, 50, 40, 30, 20, 15, 10, and 5. In some embodiments, the ratio of the GIP potency of Q compared to the GLP-1 potency of Q is less than 5 (e.g., about 4, about 3, about 2, about 1). In some embodiments, Q has an $EC_{50}$ at the GIP receptor which is 2- to 10-fold (e.g., 2-fold, 3-fold, 4-fold, 5-fold, 6-fold, 7-fold, 8-fold, 9-fold, 10-fold) greater than the $EC_{50}$ at the GLP-1 receptor.

In some embodiments, the ratio of the relative activity or potency or the $EC_{50}$ of Q at the GLP-1 receptor divided by the relative activity or potency or the $EC_{50}$ of Q at the GIP receptor is less than, or is about, V, wherein V is selected from 100, 75, 60, 50, 40, 30, 20, 15, 10, or 5. In some embodiments, the ratio of the $EC_{50}$ or potency or relative activity of Q at the GLP-1 receptor divided by the $EC_{50}$ or potency or relative activity of Q at the GIP receptor is less than 5 (e.g., about 4, about 3, about 2, about 1). In some embodiments, the ratio of the GLP-1 potency of Q compared to the GIP potency of Q is less than, or is about, W, wherein W is selected from 100, 75, 60, 50, 40, 30, 20, 15, 10, and 5. In some embodiments, the ratio of the GLP-1 potency of Q compared to the GIP potency of Q is less than 5 (e.g., about 4, about 3, about 2, about 1). In some embodiments, Q has an $EC_{50}$ at the GLP-1 receptor which is about 2- to about 10-fold (e.g., 2-fold, 3-fold, 4-fold, 5-fold, 6-fold, 7-fold, 8-fold, 9-fold, 10-fold) greater than the $EC_{50}$ at the GIP receptor.

In some embodiments, Q exhibits at least 0.1% (e.g., about 0.5% or more, about 1% or more, about 5% or more, about 10% or more, or more) of the activity of native GLP-1 at the GLP-1 receptor (GLP-1 potency) and exhibits at least 0.1% (e.g., about 0.5% or more, about 1% or more, about 5% or more, about 10% or more, or more) of the activity of native GIP at the GIP receptor (GIP potency).

Selectivity of Q for the GIP receptor versus the GLP-1 receptor can be described as the relative ratio of GIP/GLP-1 activity (Q's activity at the GIP receptor relative to native GIP, divided by the analog's activity at the GLP-1 receptor relative to native GLP-1). For example, a Q that exhibits 60% of the activity of native GIP at the GIP receptor and 60% of the activity of native GLP-1 at the GLP-1 receptor has a 1:1 ratio of GIP/GLP-1 activity. Exemplary ratios of GIP/GLP-1 activity include about 1:1, 1.5:1, 2:1, 3:1, 4:1, 5:1, 6:1, 7:1, 8:1, 9:1 or 10:1, or about 1:10, 1:9, 1:8, 1:7, 1:6, 1:5, 1:4, 1:3, 1:2, or 1:1.5. As an example, a GIP/GLP-1 activity ratio of 10:1 indicates a 10-fold selectivity for the GIP receptor versus the GLP-1 receptor. Similarly, a GLP-1/GIP activity ratio of 10:1 indicates a 10-fold selectivity for the GLP-1 receptor versus the GIP receptor.

Activity at the Glucagon Receptor and the GIP Receptor

In some embodiments, Q exhibits activity at both the glucagon receptor and GIP receptor ("GIP/glucagon receptor co-agonists"). In some embodiments, the activity (e.g., the $EC_{50}$ or the relative activity or potency) of Q at the GIP receptor is within about 50-fold, about 40-fold, about 30-fold, about 20-fold, about 10-fold, or about 5 fold different (higher or lower) from its activity (e.g., the $EC_{50}$ or the relative activity or potency) at the glucagon receptor. In some embodiments, the GIP potency of Q is within about 25-, about 20-, about 15-, about 10-, or about 5-fold different (higher or lower) from its glucagon potency.

In some embodiments, the ratio of the relative activity or the $EC_{50}$ or the potency of the Q at the GIP receptor divided by the relative activity or the $EC_{50}$ or potency of Q at the glucagon receptor is less than, or is about, X, wherein X is selected from 100, 75, 60, 50, 40, 30, 20, 15, 10, or 5. In some embodiments, the ratio of the $EC_{50}$ or potency or relative activity of Q at the GIP receptor divided by the $EC_{50}$ or potency or relative activity of Q at the glucagon receptor is about 1 less than 5 (e.g., about 4, about 3, about 2, about 1). In some embodiments, the ratio of the GIP potency of Q compared to the glucagon potency of Q is less than, or is about, Z, wherein Z is selected from 100, 75, 60, 50, 40, 30, 20, 15, 10, and 5. In some embodiments, the ratio of the GIP potency of Q compared to the glucagon potency of Q is less than 5 (e.g., about 4, about 3, about 2, about 1). In some embodiments, Q has an $EC_{50}$ at the GIP receptor which is 2- to 10-fold (e.g., 2-fold, 3-fold, 4-fold, 5-fold, 6-fold, 7-fold, 8-fold, 9-fold, 10-fold) greater than the $EC_{50}$ at the glucagon receptor.

In some embodiments, the ratio of the relative activity or potency or the $EC_{50}$ of Q at the glucagon receptor divided by the relative activity or potency or the $EC_{50}$ of Q at the GIP receptor is less than, or is about, V, wherein V is selected from 100, 75, 60, 50, 40, 30, 20, 15, 10, or 5. In some embodiments, the ratio of the $EC_{50}$ or potency or relative activity of Q at the glucagon receptor divided by the $EC_{50}$ or potency or relative activity of Q at the GIP receptor is less than 5 (e.g., about 4, about 3, about 2, about 1). In some embodiments, the ratio of the glucagon potency of Q compared to the GIP potency of Q is less than, or is about, W, wherein W is selected from 100, 75, 60, 50, 40, 30, 20, 15, 10, and 5. In some embodiments, the ratio of the glucagon potency of Q compared to the GIP potency of Q is less than 5 (e.g., about 4, about 3, about 2, about 1). In some embodiments, Q has an $EC_{50}$ at the glucagon receptor which is about 2- to about 10-fold (e.g., 2-fold, 3-fold, 4-fold, 5-fold, 6-fold, 7-fold, 8-fold, 9-fold, 10-fold) greater than the $EC_{50}$ at the GIP receptor.

In some embodiments, Q exhibits at least 0.1% (e.g., about 0.5% or more, about 1% or more, about 5% or more, about 10% or more, or more) of the activity of native glucagon at the glucagon receptor (glucagon potency) and exhibits at least 0.1% (e.g., about 0.5% or more, about 1% or more, about 5% or more, about 10% or more, or more) of the activity of native GIP at the GIP receptor (GIP potency).

Selectivity of Q for the GIP receptor versus the glucagon receptor can be described as the relative ratio of GIP/glucagon activity (Q's activity at the GIP receptor relative to native GIP, divided by the analog's activity at the glucagon receptor relative to native glucagon). For example, a Q that exhibits 60% of the activity of native GIP at the GIP receptor and 60% of the activity of native glucagon at the glucagon receptor has a 1:1 ratio of GIP/glucagon activity. Exemplary ratios of GIP/glucagon activity include about 1:1, 1.5:1, 2:1, 3:1, 4:1, 5:1, 6:1, 7:1, 8:1, 9:1 or 10:1, or about 1:10, 1:9, 1:8, 1:7, 1:6, 1:5, 1:4, 1:3, 1:2, or 1:1.5. As an example, a GIP/glucagon activity ratio of 10:1 indicates a 10-fold selectivity for the GIP receptor versus the glucagon receptor. Similarly, a glucagon/GIP activity ratio of 10:1 indicates a 10-fold selectivity for the glucagon receptor versus the GIP receptor.

Activity at the Glucagon Receptor, the GLP-1 Receptor, and the GIP Receptor

In some embodiments, Q exhibits activity at all three of the glucagon receptor, the GLP-1 receptor, and the GIP receptor ("glucagon/GLP-1/GIP receptor tri-agonists"). In some embodiments, the activity (e.g., the $EC_{50}$ or the relative activity or potency) of Q at the glucagon receptor is within about 100-fold, about 75-fold, about 60-fold, 50-fold, about 40-fold, about 30-fold, about 20-fold, about 10-fold, or about 5 fold different (higher or lower) from its activity (e.g., the $EC_{50}$ or the relative activity or potency) at both the GLP-1 receptor and the GIP receptor. In some embodiments, the activity (e.g., the $EC_{50}$ or the relative activity or potency) of Q at the GLP-1 receptor is within about 100-fold, about 75-fold, about 60-fold, 50-fold, about 40-fold, about 30-fold, about 20-fold, about 10-fold, or about 5 fold different (higher or lower) from its activity (e.g., the $EC_{50}$ or the relative activity or potency) at both the glucagon receptor and the GIP receptor. In some embodiments, the activity (e.g., the $EC_{50}$ or the relative activity or potency) of Q at the GIP receptor is within about 100-fold, about 75-fold, about 60-fold, 50-fold, about 40-fold, about 30-fold, about 20-fold, about 10-fold, or about 5 fold different (higher or lower) from its activity (e.g., the $EC_{50}$ or the relative activity or potency) at both the glucagon receptor and the GLP-1 receptor. This fold difference can be alternatively expressed as ratios of glucagon/GLP-1, or GLP-1/GIP, or glucagon/GLP-1 as above.

Structure of the Glucagon Superfamily Peptide (Q)

The glucagon superfamily peptide (Q) described herein can comprise an amino acid sequence which is based on the amino acid sequence of native human glucagon (SEQ ID NO: 1601), native human GLP-1 (SEQ ID NOs: 1603 or 1604), or native human GIP (SEQ ID NO: 1607).

Based on Native Human Glucagon

In some aspects of the invention, the glucagon superfamily peptide (Q) comprises an amino acid sequence that is based on the amino acid sequence of native human glucagon (SEQ ID NO: 1601). In some aspects, Q comprises a modified amino acid sequence of SEQ ID NO: 1601 comprising 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.), amino acid modifications. In some embodiments, Q comprises a total of 1, up to 2, up to 3, up to 4, up to 5, up to 6, up to 7, up to 8, up to 9, or up to 10 amino acid modifications relative to the native human glucagon sequence (SEQ ID NO: 1601). In some embodiments, the modifications are any of those described herein, e.g., acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29.

In some embodiments, Q comprises an amino acid sequence which has at least 25% sequence identity to the amino acid sequence of native human glucagon (SEQ ID NO: 1601). In some embodiments, Q comprises an amino acid sequence which is at least 30%, at least 40%, at least 50%, at least 60%, at least 70%, at least 80%, at least 85%, at least 90% or has greater than 90% sequence identity to SEQ ID NO: 1601. In some embodiments, the amino acid sequence of Q, which has the above-referenced % sequence identity is the full-length amino acid sequence of Q. In some embodiments, the amino acid sequence of Q which has the above-referenced % sequence identity is only a portion of the amino acid sequence of Q. In some embodiments, Q comprises an amino acid sequence which has about A % or greater sequence identity to a reference amino acid sequence of at least 5 contiguous amino acids (e.g., at least 6, at least 7, at least 8, at least 9, at least 10 amino acids) of SEQ ID NO: 1601, wherein the reference amino acid sequence begins with the amino acid at position C of SEQ ID NO: 1601 and ends with the amino acid at position D of SEQ ID NO: 1601, wherein A is 25, 30, 35, 40, 45, 50, 55, 60, 65, 70, 75, 80, 85, 90, 91, 92, 93, 94, 95, 96, 97, 98, 99; C is 1, 2, 3, 4, 5, 6, 7, 8, 9, 10, 11, 12, 13, 14, 15, 16, 17, 18, 19, 20, 21, 22, 23, 24, 25, 26, 27, or 28 and D is 5, 6, 7, 8, 9, 10, 11, 12, 13, 14, 15, 16, 17, 18, 19, 20, 21, 22, 23, 24, 25, 26, 27, 28 or 29. Any and all possible combinations of the foregoing parameters are envisioned, including but not limited to, e.g., wherein A is 90% and C and D are 1 and 27, or 6 and 27, or 8 and 27, or 10 and 27, or 12 and 27, or 16 and 27.

Based on Native Human GLP-1

In some aspects of the invention, the glucagon superfamily peptide (Q) comprises an amino acid sequence that is based on the amino acid sequence of native human GLP-1 (SEQ ID NO: 1603). In some aspects, Q comprises a modified amino acid sequence of SEQ ID NO: 1603 comprising 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.), amino acid modifications. In some embodiments, Q comprises a total of 1, up to 2, up to 3, up to 4, up to 5, up to 6, up to 7, up to 8, up to 9, or up to 10 amino acid modifications relative to the native human GLP-1 sequence (SEQ ID NO: 1603). In some embodiments, the modifications are any of those described herein, e.g., acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29.

In some embodiments, Q comprises an amino acid sequence which has at least 25% sequence identity to the amino acid sequence of native human GLP-1 (SEQ ID NO: 1603). In some embodiments, Q comprises an amino acid sequence which is at least 30%, at least 40%, at least 50%, at least 60%, at least 70%, at least 80%, at least 85%, at least 90% or has greater than 90% sequence identity to SEQ ID NO: 1603. In some embodiments, the amino acid sequence of Q, which has the above-referenced % sequence identity is the full-length amino acid sequence of Q. In some embodiments, the amino acid sequence of Q which has the above-referenced % sequence identity is only a portion of the amino acid sequence of Q. In some embodiments, Q comprises an amino acid sequence which has about A % or greater sequence identity to a reference amino acid sequence of at least 5 contiguous amino acids (e.g., at least 6, at least 7, at least 8, at least 9, at least 10 amino acids) of SEQ ID NO: 1603, wherein the reference amino acid sequence begins with the amino acid at position C of SEQ ID NO: 1603 and ends with the amino acid at position D of SEQ ID NO: 1603, wherein A is 25, 30, 35, 40, 45, 50, 55, 60, 65, 70, 75, 80, 85, 90, 91, 92, 93, 94, 95, 96, 97, 98, 99; C is 1, 2, 3, 4, 5, 6, 7, 8, 9, 10, 11, 12, 13, 14, 15, 16, 17, 18, 19, 20, 21, 22, 23, 24, 25, 26, 27, or 28 and D is 5, 6, 7, 8, 9, 10, 11, 12, 13, 14, 15, 16, 17, 18, 19, 20, 21, 22, 23, 24, 25, 26, 27, 28 or 29. Any and all possible combinations of the foregoing parameters are envisioned, including but not limited to, e.g., wherein A is 90% and C and D are 1 and 27, or 6 and 27, or 8 and 27, or 10 and 27, or 12 and 27, or 16 and 27.

Based on Native Human GIP

In some embodiments of the present disclosures, Q is an analog of native human GIP, the amino acid sequence of which is provided herein as SEQ ID NO: 1607. Accordingly, in some embodiments, Q comprises an amino acid sequence which is based on the amino acid sequence of SEQ ID NO: 1607 but is modified with 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.), amino acid modifications. In some embodiments, Q comprises a total of 1, up to 2, up to 3, up to 4, up to 5, up to 6, up to 7, up to 8, up to 9, or up to 10 amino acid modifications relative to the native human GIP sequence (SEQ ID NO: 1607). In some embodiments, the modifications are any of those described herein, e.g., acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29. Exemplary GIP receptor agonists are known in the art. See, for example, Irwin et al., *J Pharm and Expmt Ther* 314(3): 1187-1194 (2005); Salhanick et al., *Bioorg Med Chem Lett* 15(18): 4114-4117 (2005); Green et al., *Diabetes* 7(5): 595-604 (2005); O'Harte et al., *J Endocrinol* 165(3): 639-648 (2000); O'Harte et al., *Diabetologia* 45(9): 1281-1291 (2002); Gault et al., *Biochem J* 367 (Pt3): 913-920 (2002); Gault et al., *J Endocrin* 176: 133-141 (2003); Irwin et al., *Diabetes Obes Metab.* 11(6): 603-610 (epub 2009).

In some embodiments, Q comprises an amino acid sequence which has at least 25% sequence identity to the amino acid sequence of native human GIP (SEQ ID NO: 1607). In some embodiments, Q comprises an amino acid sequence which is at least 30%, at least 40%, at least 50%, at least 60%, at least 70%, at least 80%, at least 85%, at least 90% or has greater than 90% sequence identity to SEQ ID NO: 1607. In some embodiments, the amino acid sequence of Q which has the above-referenced % sequence identity is the full-length amino acid sequence of Q. In some embodiments, the amino acid sequence of Q which has the above-referenced % sequence identity is only a portion of the amino acid sequence of Q. In some embodiments, Q comprises an amino acid sequence which has about A % or greater sequence identity to a reference amino acid sequence of at least 5 contiguous amino acids (e.g., at least 6, at least 7, at least 8, at least 9, at least 10 amino acids) of SEQ ID NO: 1607, wherein the reference amino acid sequence begins with the amino acid at position C of SEQ ID NO: 1607 and ends with the amino acid at position D of SEQ ID NO: 1607, wherein A is 25, 30, 35, 40, 45, 50, 55, 60, 65, 70, 75, 80, 85, 90, 91, 92, 93, 94, 95, 96, 97, 98, 99; C is 1, 2, 3, 4, 5, 6, 7, 8, 9, 10, 11, 12, 13, 14, 15, 16, 17, 18, 19, 20, 21, 22, 23, 24, 25, 26, 27, or 28 and D is 5, 6, 7, 8, 9, 10, 11, 12, 13, 14, 15, 16, 17, 18, 19, 20, 21, 22, 23, 24, 25, 26, 27, 28 or 29. Any and all possible combinations of the foregoing parameters are envisioned, including but not limited to, e.g., wherein A is 90% and C and D are 1 and 27, or 6 and 27, or 8 and 27, or 10 and 27, or 12 and 27, or 16 and 27.

Modifications

When Q is a glucagon related peptide, Q can comprise the native glucagon amino acid sequence (SEQ ID NO: 1601) with modifications. In exemplary embodiments, the glucagon related peptide may comprise a total of 1, up to 2, up to 3, up to 4, up to 5, up to 6, up to 7, up to 8, up to 9, or up to 10 amino acid modifications relative to the native glucagon sequence, e.g. conservative or non-conservative substitutions. Modifications and substitutions described herein are, in certain aspects made at specific positions within Q wherein the numbering of the position corresponds to the numbering of glucagon (SEQ ID NO: 1601). In some embodiments 1, 2, 3, 4 or 5 non-conservative substitutions are carried out at any of positions 2, 5, 7, 10, 11, 12, 13, 14, 17, 18, 19, 20, 21, 24, 27, 28 or 29 and up to 5 further conservative substitutions are carried out at any of these positions. In some embodiments 1, 2, or 3 amino acid modifications are carried out within amino acids at positions 1-16, and 1, 2 or 3 amino acid modifications are carried out within amino acids at positions 17-26. In some embodiments, Q retains at least 22, 23, 24, 25, 26, 27 or 28 of the naturally occurring amino acids at the corresponding positions in native glucagon (e.g. have 1-7, 1-5 or 1-3 modifications relative to naturally occurring glucagon).

DPP-IV Resistance

In some embodiments where Q is a glucagon related peptide, Q comprises a modification at position 1 or 2 to reduce susceptibility to cleavage by dipeptidyl peptidase IV (DPP-IV). More particularly, in some embodiments, position 1 of Q (e.g., selected from those in FIG. 1) is substituted with an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of Q is substituted with an amino acid selected from the group consisting of D-serine, D-alanine, valine, glycine, N-methyl serine, and aminoisobutyric acid. In some embodiments, position 2 of the glucagon related peptide is not D-serine.

Glucagon Modification at Position 3

Glucagon related peptides of Classes 1 to 3 described herein may be modified at position 3 (according to the amino acid numbering of wild type glucagon) to maintain or increase activity at the glucagon receptor.

In some embodiments in which Q is a Class 1, Class 2, or Class 3 glucagon related peptide, maintained or enhanced activity at the glucagon receptor may be achieved by modifying the Gln at position 3 with a glutamine analog. For example, a Class 1, Class 2, or Class 3 glucagon related peptide comprising a glutamine analog at position 3 may exhibit about 5%, about 10%, about 20%, about 50%, or about 85% or greater the activity of native glucagon (SEQ ID NO: 1601) at the glucagon receptor. In some embodiments a Class 1, Class 2, or Class 3 glucagon related peptide comprising a glutamine analog at position 3 may exhibit about 20%, about 50%, about 75%, about 100%, about 200% or about 500% or greater the activity of a corresponding glucagon peptide having the same amino acid sequence as the peptide comprising the glutamine analog, except for the modified amino acid at position 3 at the glucagon receptor. In some embodiments, a Class 1, Class 2, or Class 3 glucagon related peptide comprising a glutamine analog at position 3 exhibits enhanced activity at the glucagon receptor, but the enhanced activity is no more than 1000%, 10,000%, 100,000%, or 1,000,000% of the activity of native glucagon or of a corresponding glucagon related peptide having the same amino acid sequence as the peptide comprising the glutamine analog, except for the modified amino acid at position 3.

In some embodiments, the glutamine analog is a naturally occurring or a non-naturally occurring amino acid comprising a side chain of Structure I, II or III:

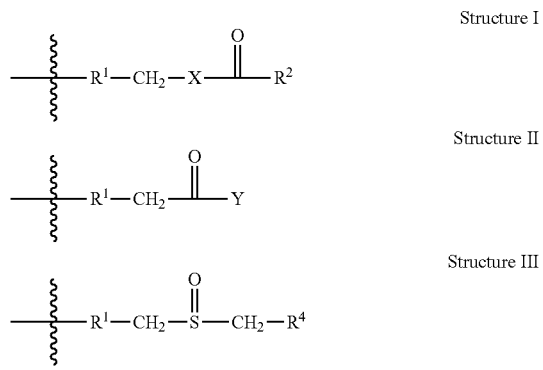

wherein $R^1$ is $C_{0-3}$ alkyl or $C_{0-3}$ heteroalkyl; $R^2$ is $NHR^4$ or $C_{1-3}$ alkyl; $R^3$ is $C_{1-3}$ alkyl; $R^4$ is H or $C_{1-3}$ alkyl; X is NH, O, or S; and Y is $NHR^4$, $SR^3$, or $OR^3$. In some embodiments, X is NH or Y is $NHR^4$. In some embodiments, $R^1$ is $C_{0-2}$ alkyl or $C_1$ heteroalkyl. In some embodiments, $R^2$ is $NHR^4$ or $C_1$ alkyl. In some embodiments, $R^4$ is H or $C^1$ alkyl. In exemplary embodiments in which Q is a Class 1, Class 2, or Class 3 glucagon related peptide, an amino acid comprising a side chain of Structure I is provided where, $R^1$ is $CH_2$—S, X is NH, and $R^2$ is $CH_3$ (acetamidomethyl-cysteine, C(Acm)); $R^1$ is $CH_2$, X is NH, and $R^2$ is $CH_3$ (acetyldiaminobutanoic acid, Dab(Ac)); $R^1$ is $C_0$ alkyl, X is NH, $R^2$ is $NHR^4$, and $R^4$ is H (carbamoyldiaminopropanoic acid, Dap(urea)); or $R^1$ is $CH_2$—$CH_2$, X is NH, and $R^2$ is $CH_3$ (acetylornithine, Orn (Ac)). In exemplary embodiments an amino acid comprising a side chain of Structure II is provided where, $R^1$ is $CH_2$, Y is $NHR^4$, and $R^4$ is $CH_3$ (methylglutamine, Q(Me)); In exemplary embodiments an amino acid comprising a side chain of Structure III is provided where, $R^1$ is $CH_2$ and $R^4$ is H (methionine-sulfoxide, M(O)); In specific embodiments, the amino acid at position 3 is substituted with Dab(Ac).

Acylation of Q

In some embodiments, the glucagon related peptide (e.g. a Class 1 glucagon related peptide, Class 2 glucagon related peptide, Class 3 glucagon related peptide, Class 4 glucagon related peptide, Class 4 glucagon related peptides or Class 5 glucagon related peptide), Q is modified to comprise an acyl group. The acyl group can be covalently linked directly to an amino acid of the peptide Q, or indirectly to an amino acid of Q via a spacer, wherein the spacer is positioned between the amino acid of Q and the acyl group. Q may be acylated at the same amino acid position where a hydrophilic moiety is linked, or at a different amino acid position. As described herein, Q can be a glucagon superfamily peptide, glucagon related peptide, including a Class 1, 2, 3, 4 or 5 glucagon related peptide, or osteocalcin, calcitonin, amylin, or an analog, derivative or conjugate thereof. For example, Q may be one of Class 1, Class 2, Class 3, Class 4 or Class 5, and may comprise an acyl group which is non-native to a naturally-occurring amino acid. Acylation can be carried out at any position within Q. Where Q is a glucagon related peptide, acylation may occur at any position including any of positions 1-29, a position within a C-terminal extension, or the C-terminal amino acid, provided that the activity exhibited by the non-acylated glucagon related peptide is retained upon acylation. For example, if the unacylated peptide has glucagon agonist activity, then the acylated peptide retains the glucagon agonist activity. Also for example, if the unacylated peptide has glucagon antagonist activity, then the acylated peptide retains the glucagon antagonist activity. For instance, if the unacylated peptide has GLP-1 agonist activity, then the acylated peptide retains GLP-1 agonist activity. Nonlimiting examples include acylation at positions 5, 7, 10, 11, 12, 13, 14, 16, 17, 18, 19, 20, 21, 24, 27, 28, or 29 (according to the amino acid numbering of wild type glucagon). With regard to Class 1, Class 2, and Class 3 glucagon related peptides, acylation may occur at any of positions 5, 7, 10, 11, 12, 13, 14, 16, 17, 18, 19, 20, 21, 24, 27, 28, 29, 30, 37, 38, 39, 40, 41, 42, or 43 (according to the amino acid numbering of wild type glucagon). Other nonlimiting examples with respect to glucagon related peptides (e.g., Class 1, 2, 3, 4, or 5) include acylation at position 10 (according to the amino acid numbering of the wild type glucagon) and pegylation at one or more positions in the C-terminal portion of the glucagon peptide, e.g., position 24, 28 or 29 (according to the amino acid numbering of the wild type glucagon), within a C-terminal extension, or at the C-terminus (e.g., through adding a C-terminal Cys).

In a specific aspect of the invention, peptide Q (e.g., a glucagon superfamily peptide, a glucagon related peptide, a Class 1, 2, 3, 4 or 5 glucagon related peptide, or osteocalcin, calcitonin, amylin, or an analog, derivative or conjugate thereof) is modified to comprise an acyl group by direct acylation of an amine, hydroxyl, or thiol of a side chain of an amino acid of Q. In some embodiments, Q is directly acylated through the side chain amine, hydroxyl, or thiol of an amino acid. In some embodiments, where Q is a glucagon related peptide, acylation is at position 10, 20, 24, or 29 (according to the amino acid numbering of the wild type glucagon). In this regard, the acylated glucagon related peptide can comprise the amino acid sequence of SEQ ID NO: 1601, or a modified amino acid sequence thereof comprising one or more of the amino acid modifications described herein, with at least one of the amino acids at positions 10, 20, 24, and 29 (according to the amino acid numbering of the wild type glucagon) modified to any amino acid comprising a side chain amine, hydroxyl, or thiol. In some specific embodiments of the invention, where Q is a glucagon related peptide, the direct acylation of the Q occurs through the side chain amine, hydroxyl, or thiol of the amino acid at position 10 (according to the amino acid numbering of the wild type glucagon).

In some embodiments, the amino acid of peptide Q (e.g., a glucagon superfamily peptide, a glucagon related peptide, a Class 1, 2, 3, 4 or 5 glucagon related peptide, or osteocalcin, calcitonin, amylin, or an analog, derivative or conjugate thereof) comprising a side chain amine is an amino acid of Formula I:

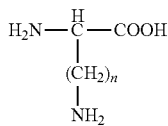

[Formula I]

wherein n = 1 to 4

In some exemplary embodiments, the amino acid of Formula I, is the amino acid wherein n is 4 (Lys) or n is 3 (Orn).

In other embodiments, the amino acid of peptide Q comprising a side chain hydroxyl is an amino acid of Formula II:

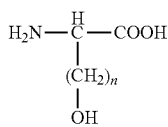

[Formula II]

wherein n = 1 to 4

In some exemplary embodiments, the amino acid of Formula II is the amino acid wherein n is 1 (Ser).

In yet other embodiments, the amino acid of peptide Q comprising a side chain thiol is an amino acid of Formula III:

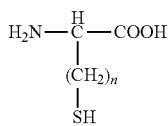

[Formula III]

wherein n = 1 to 4

In some exemplary embodiments, the amino acid of Formula III is the amino acid wherein n is 1 (Cys).

In yet other embodiments, the amino acid of peptide Q comprising a side chain amine, hydroxyl, or thiol is a disubstituted amino acid comprising the same structure of Formula I, Formula II, or Formula III, except that the hydrogen bonded to the alpha carbon of the amino acid of Formula I, Formula II, or Formula III is replaced with a second side chain.

In some embodiments of the invention, the acylated peptide Q (e.g., a glucagon superfamily peptide, a glucagon related peptide, a Class 1, 2, 3, 4 or 5 glucagon related peptide, or osteocalcin, calcitonin, amylin, or an analog, derivative or conjugate thereof) comprises a spacer between the peptide and the acyl group. In some embodiments, Q is covalently bound to the spacer, which is covalently bound to the acyl group. In some exemplary embodiments, Q is modified to comprise an acyl group by acylation of an amine, hydroxyl, or thiol of a spacer, which spacer (where Q is a glucagon related peptide, e.g., Class 1, 2, 3, 4 or 5) is attached to a side chain of an amino acid at position 10, 20, 24, or 29 (according to the amino acid numbering of the wild type glucagon), or at the C-terminal amino acid of the glucagon related peptide. The amino acid of peptide Q to which the spacer is attached can be any amino acid comprising a moiety which permits linkage to the spacer. For example, an amino acid comprising a side chain —NH$_2$, —OH, or —COOH (e.g., Lys, Orn, Ser, Asp, or Glu) is suitable. An amino acid of peptide Q (e.g., a singly or doubly α-substituted amino acid) comprising a side chain —NH$_2$, —OH, or —COOH (e.g., Lys, Orn, Ser, Asp, or Glu) is also suitable. In some embodiments where Q is a glucagon related peptide (e.g., Class 1, 2, 3, 4 or 5), the acylated glucagon related peptide can comprise the amino acid sequence of SEQ ID NO: 1601, or a modified amino acid sequence thereof comprising one or more of the amino acid modifications described herein, with at least one of the amino acids at positions 10, 20, 24, and 29 (according to the amino acid numbering of the wild type glucagon) modified to any amino acid comprising a side chain amine, hydroxyl, or carboxylate.

In some embodiments, the spacer between the peptide Q and the acyl group is an amino acid comprising a side chain amine, hydroxyl, or thiol, or a dipeptide or tripeptide comprising an amino acid comprising a side chain amine, hydroxyl, or thiol. In some embodiments, the amino acid spacer is not γ-Glu. In some embodiments, the dipeptide spacer is not γ-Glu-γ-Glu.

When acylation occurs through an amine group of the amino acid of the spacer, the acylation can occur through the alpha amine of the amino acid or a side chain amine. In the instance in which the alpha amine is acylated, the spacer amino acid can be any amino acid. For example, the spacer amino acid can be a hydrophobic amino acid, e.g., Gly, Ala, Val, Leu, Ile, Trp, Met, Phe, Tyr. In some embodiments, the spacer amino acid can be, for example, a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, 8-aminooctanoic acid. Alternatively, the spacer amino acid can be an acidic residue, e.g., Asp and Glu. In the instance in which the side chain amine of the spacer amino acid is acylated, the spacer amino acid is an amino acid comprising a side chain amine, e.g., an amino acid of Formula I (e.g., Lys or Orn). In this instance, it is possible for both the alpha amine and the side chain amine of the spacer amino acid to be acylated, such that the peptide is diacylated. Embodiments of the invention include such diacylated molecules.

When acylation occurs through a hydroxyl group of the amino acid of the spacer, the amino acid or one of the amino acids of the dipeptide or tripeptide can be an amino acid of Formula II. In a specific exemplary embodiment, the amino acid is Ser.

When acylation occurs through a thiol group of the amino acid of the spacer, the amino acid or one of the amino acids of the dipeptide or tripeptide can be an amino acid of Formula III. In a specific exemplary embodiment, the amino acid is Cys.

In some embodiments, the spacer comprises a hydrophilic bifunctional spacer. In a specific embodiment, the spacer comprises an amino poly(alkyloxy)carboxylate. In this regard, the spacer can comprise, for example, NH$_2$(CH$_2$CH$_2$O)$_n$(CH$_2$)$_m$COOH, wherein m is any integer from 1 to 6 and n is any integer from 2 to 12, such as, e.g., 8-amino-3,6-dioxaoctanoic acid, which is commercially available from Peptides International, Inc. (Louisville, Ky.).

In some embodiments the spacer between peptide Q and the acyl group comprises a hydrophilic bifunctional spacer. In certain embodiments, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate.

In some embodiments, the spacer between peptide Q and the acyl group is a hydrophobic bifunctional spacer. Hydrophobic bifunctional spacers are known in the art. See, e.g., *Bioconjugate Techniques*, G. T. Hermanson (Academic Press, San Diego, Calif., 1996), which is incorporated by reference in its entirety. In certain embodiments, the hydrophobic bifunctional spacer comprises two or more reactive groups, e.g., an amine, a hydroxyl, a thiol, and a carboxyl group or any combinations thereof. In certain embodiments, the hydrophobic bifunctional spacer comprises a hydroxyl group and a carboxylate. In other embodiments, the hydrophobic bifunctional spacer comprises an amine group and a carboxylate. In other embodiments, the hydrophobic bifunctional spacer comprises a thiol group and a carboxylate. Suitable hydrophobic bifunctional spacers comprising a carboxylate and a hydroxyl group or a thiol group are known in the art and include, for example, 8-hydroxyoctanoic acid and 8-mercaptooctanoic acid.

In some embodiments, the bifunctional spacer is not a dicarboxylic acid comprising an unbranched, methylene of 1 to 7 carbon atoms between the carboxylate groups. In some embodiments, the bifunctional spacer is a dicarboxylic acid comprising an unbranched, methylene of 1-7 carbon atoms between the carboxylate groups.

The spacer (e.g., amino acid, dipeptide, tripeptide, hydrophilic bifunctional spacer, or hydrophobic bifunctional spacer) in specific embodiments, wherein Q is a Class 1, Class 2, or Class 3 glucagon related peptide, is 3 to 10 atoms (e.g., 6 to 10 atoms, (e.g., 6, 7, 8, 9, or 10 atoms) in length. In more specific embodiments in which Q is a Class 1, Class 2, or Class 3 glucagon related peptide, the spacer is about 3 to 10 atoms (e.g., 6 to 10 atoms) in length and the acyl group is a C12 to C18 fatty acyl group, e.g., C14 fatty acyl group, C16 fatty acyl group, such that the total length of the spacer and acyl group is 14 to 28 atoms, e.g., about 14, 15, 16, 17, 18, 19, 20, 21, 22, 23, 24, 25, 26, 27, or 28 atoms. In some embodiments, in which Q is a Class 1, Class 2, or Class 3 glucagon related peptide the length of the spacer and acyl group is 17 to 28 (e.g., 19 to 26, 19 to 21) atoms.

In accordance with certain embodiments in which Q is a Class 1, Class 2, or Class 3 glucagon related peptide, the bifunctional spacer can be a synthetic or naturally occurring amino acid (including, but not limited to, any of those described herein) comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer attached to the Class 1, Class 2, or Class 3 glucagon related peptide can be a dipeptide or tripeptide spacer having a peptide backbone that is 3 to 10 atoms (e.g., 6 to 10 atoms) in length. Each amino acid of the dipeptide or tripeptide spacer attached to the Class 1, Class 2, or Class 3 glucagon related peptide can be the same as or different from the other amino acid(s) of the dipeptide or tripeptide and can be independently selected from the group consisting of: naturally-occurring and/or non-naturally occurring amino acids, including, for example, any of the D or L isomers of the naturally-occurring amino acids (Ala, Cys, Asp, Glu, Phe, Gly, His, Ile, Lys, Leu, Met, Asn, Pro, Arg, Ser, Thr, Val, Trp, Tyr), or any D or L isomers of the non-naturally occurring amino acids selected from the group consisting of: β-alanine β-Ala), N-α-methyl-alanine (Me-Ala), aminobutyric acid (Abu), a-aminobutyric acid (γ-Abu), aminohexanoic acid (ε-Ahx), aminoisobutyric acid (Aib), aminomethylpyrrole carboxylic acid, aminopiperidinecarboxylic acid, aminoserine (Ams), aminotetrahydropyran-4-carboxylic acid, arginine N-methoxy-N-methyl amide, β-aspartic acid (β-Asp), azetidine carboxylic acid, 3-(2-benzothiazolyl)alanine, α-tert-butylglycine, 2-amino-5-ureido-n-valeric acid (citrulline, Cit), β-Cyclohexylalanine (Cha), acetamidomethyl-cysteine, diaminobutanoic acid (Dab), diaminopropionic acid (Dpr), dihydroxyphenylalanine (DOPA), dimethylthiazolidine (DMTA), γ-Glutamic acid (γ-Glu), homoserine (Hse), hydroxyproline (Hyp), isoleucine N-methoxy-N-methyl amide, methyl-isoleucine (MeIle), isonipecotic acid (Isn), methyl-leucine (MeLeu), methyl-lysine, dimethyl-lysine, trimethyl-lysine, methanoproline, methionine-sulfoxide (Met(O)), methionine-sulfone (Met(02)), norleucine (Nle), methyl-norleucine (Me-Nle), norvaline (Nva), ornithine (Orn), para-aminobenzoic acid (PABA), penicillamine (Pen), methylphenylalanine (MePhe), 4-Chlorophenylalanine (Phe(4-Cl)), 4-fluorophenylalanine (Phe(4-F)), 4-nitrophenylalanine (Phe(4-NO2)), 4-cyanophenylalanine ((Phe (4-CN)), phenylglycine (Phg), piperidinylalanine, piperidinylglycine, 3,4-dehydroproline, pyrrolidinylalanine, sarcosine (Sar), selenocysteine (Sec), O-Benzyl-phosphoserine, 4-amino-3-hydroxy-6-methylheptanoic acid (Sta), 4-amino-5-cyclohexyl-3-hydroxypentanoic acid (ACHPA), 4-amino-3-hydroxy-5-phenylpentanoic acid (AHPPA), 1,2, 3,4,-tetrahydro-isoquinoline-3-carboxylic acid (Tic), tetrahydropyranglycine, thienylalanine (Thi), O-benzyl-phosphotyrosine, O-Phosphotyrosine, methoxytyrosine, ethoxytyrosine, O-(bis-dimethylamino-phosphono)-tyrosine, tyrosine sulfate tetrabutylamine, methyl-valine (Me-Val), 1-amino-1-cyclohexane carboxylic acid (Acx), aminovaleric acid, beta-cyclopropyl-alanine (Cpa), propargylglycine (Prg), allylglycine (Alg), 2-amino-2-cyclohexyl-propanoic acid (2-Cha), tertbutylglycine (Tbg), vinylglycine (Vg), 1-amino-1-cyclopropane carboxylic acid (Acp), 1-amino-1-cyclopentane carboxylic acid (Acpe), alkylated 3-mercaptopropionic acid, 1-amino-1-cyclobutane carboxylic acid (Acb).

In some embodiments in which Q is a Class 1, Class 2, or Class 3 glucagon related peptide, the spacer comprises an overall negative charge, e.g., comprises one or two negatively charged amino acids. In some embodiments in which Q is a Class 1, Class 2, or Class 3 glucagon related peptide, the dipeptide is not any of the dipeptides of general structure A-B, wherein A is selected from the group consisting of Gly, Gln, Ala, Arg, Asp, Asn, Ile, Leu, Val, Phe, and Pro, wherein B is selected from the group consisting of Lys, His, Trp. In some embodiments in which Q is a Class 1, Class 2, or Class 3 glucagon related peptide, the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu.

The peptide Q can be modified to comprise an acyl group by acylation of a long chain alkane. In specific aspects, the long chain alkane comprises an amine, hydroxyl, or thiol group (e.g. octadecylamine, tetradecanol, and hexadecanethiol) which reacts with a carboxyl group, or activated form thereof, of the peptide Q. The carboxyl group, or activated form thereof, of Q can be part of a side chain of an amino acid (e.g., glutamic acid, aspartic acid) of Q or can be part of the peptide backbone.

In certain embodiments, the peptide Q is modified to comprise an acyl group by acylation of the long chain alkane by a spacer which is attached to Q. In specific aspects, the long chain alkane comprises an amine, hydroxyl, or thiol group which reacts with a carboxyl group, or activated form thereof, of the spacer. Suitable spacers comprising a carboxyl group, or activated form thereof, are described herein and include, for example, bifunctional spacers, e.g., amino acids, dipeptides, tripeptides, hydrophilic bifunctional spacers and hydrophobic bifunctional spacers.

As used herein, the term "activated form of a carboxyl group" refers to a carboxyl group with the general formula R(C=O)X, wherein X is a leaving group and R is Q or the spacer. For example, activated forms of a carboxyl groups may include, but are not limited to, acyl chlorides, anhydrides, and esters. In some embodiments, the activated carboxyl group is an ester with a N-hydroxysuccinimide (NHS) leaving group.

With regard to these aspects of the invention, in which a long chain alkane is acylated by the peptide Q or the spacer, the long chain alkane may be of any size and can comprise any length of carbon chain. The long chain alkane can be linear or branched. In certain aspects, the long chain alkane is a C4 to C30 alkane. For example, the long chain alkane can be any of a C4 alkane, C6 alkane, C8 alkane, C10 alkane, C12 alkane, C14 alkane, C16 alkane, C18 alkane, C20 alkane, C22 alkane, C24 alkane, C26 alkane, C28 alkane, or a C30 alkane. In some embodiments, the long chain alkane comprises a C8 to C20 alkane, e.g., a C14 alkane, C16 alkane, or a C18 alkane.

In some embodiments, an amine, hydroxyl, or thiol group of Q is acylated with a cholesterol acid. In a specific embodiment, the peptide is linked to the cholesterol acid through an alkylated des-amino Cys spacer, i.e., an alkylated 3-mercaptopropionic acid spacer.

Suitable methods of peptide acylation via amines, hydroxyls, and thiols are known in the art. See, for example, Miller, *Biochem Biophys Res Commun* 218: 377-382 (1996); Shimohigashi and Stammer, *Int J Pept Protein Res* 19: 54-62 (1982); and Previero et al., *Biochim Biophys Acta* 263: 7-13 (1972) (for methods of acylating through a hydroxyl); and San and Silvius, *J Pept Res* 66: 169-180 (2005) (for methods of acylating through a thiol); *Bioconjugate Chem*. "Chemical Modifications of Proteins: History and Applications" pages 1, 2-12 (1990); Hashimoto et al., *Pharmacuetical Res*. "Synthesis of Palmitoyl Derivatives of Insulin and their Biological Activity" Vol. 6, No: 2 pp. 171-176 (1989).

The acyl group of the acylated peptide Q can be of any size, e.g., any length carbon chain, and can be linear or branched. In some specific embodiments of the invention, the acyl group is a C4 to C30 fatty acid. For example, the acyl group can be any of a C4 fatty acid, C6 fatty acid, C8 fatty acid, C10 fatty acid, C12 fatty acid, C14 fatty acid, C16 fatty acid, C18 fatty acid, C20 fatty acid, C22 fatty acid, C24 fatty acid, C26 fatty acid, C28 fatty acid, or a C30 fatty acid. In some embodiments, the acyl group is a C8 to C20 fatty acid, e.g., a C14 fatty acid or a C16 fatty acid.

In an alternative embodiment, the acyl group is a bile acid. The bile acid can be any suitable bile acid, including, but not limited to, cholic acid, chenodeoxycholic acid, deoxycholic acid, lithocholic acid, taurocholic acid, glycocholic acid, and cholesterol acid.

The acylated peptides Q described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In some embodiments related to Class 1, 2, 3, 4 or 5 glucagon related peptides, the acylated glucagon related peptide can comprise SEQ ID NO: 1601, including any of the modifications described herein, in which at least one of the amino acids at position 10, 20, 24, and 29 (according to the amino acid numbering of the wild type glucagon) comprise an acyl group and at least one of the amino acids at position 16, 17, 21, 24, or 29 (according to the amino acid numbering of the wild type glucagon), a position within a C-terminal extension, or the C-terminal amino acid are modified to a Cys, Lys, Orn, homo-Cys, or Ac-Phe, and the side chain of the amino acid is covalently bonded to a hydrophilic moiety (e.g., PEG). In some embodiments related to Class 1, 2, 3, 4 or 5 glucagon related peptides, the acyl group is attached to position 10 (according to the amino acid numbering of the wild type glucagon), optionally via a spacer comprising Cys, Lys, Orn, homo-Cys, or Ac-Phe, and the hydrophilic moiety is incorporated at a Cys residue at position 24.

Alternatively, the acylated peptide (Q) can comprise a spacer, wherein the spacer is both acylated and modified to comprise the hydrophilic moiety. Nonlimiting examples of suitable spacers include a spacer comprising one or more amino acids selected from the group consisting of Cys, Lys, Orn, homo-Cys, and Ac-Phe.

Alkylation of Q

In some embodiments, Q is modified to comprise an alkyl group. The alkyl group can be covalently linked directly to an amino acid of the peptide Q, or indirectly to an amino acid of Q via a spacer, wherein the spacer is positioned between the amino acid of Q and the alkyl group. The alkyl group can be attached to Q via an ether, thioether, or amino linkage, for example. Q may be alkylated at the same amino acid position where a hydrophilic moiety is linked, or at a different amino acid position. As described herein, Q can be a glucagon superfamily peptide, glucagon related peptide, including a Class 1, 2, 3, 4 or 5 glucagon related peptide, or osteocalcin, calcitonin, amylin, or an analog, derivative or conjugate thereof. For example, Q may be a Class 1, Class 2, or Class 3 glucagon related peptide, and may comprise an alkyl group which is non-native to a naturally-occurring amino acid.

Alkylation can be carried out at any position within Q. Where Q is a glucagon related peptide, alkylation may occur at any position including any of positions 1-29, a position within a C-terminal extension, or the C-terminal amino acid, provided that an agonist activity of the unalkyated peptide with respect to glucagon, GLP-1, GIP or other glucagon-related peptide receptor is retained upon alkylation. In some embodiments, if the unalkylated peptide has glucagon agonist activity, then the alkylated peptide retains glucagon agonist activity is retained. In some embodiments, if the unalkylated peptide has GLP-1 agonist activity, then the alkylated peptide retains GLP-1 agonist activity. Nonlimiting examples include alkylation at positions 5, 7, 10, 11, 12, 13, 14, 16, 17, 18, 19, 20, 21, 24, 27, 28, or 29 (according to the amino acid numbering of wild type glucagon). With regard to Class 1, Class 2, and Class 3 glucagon related peptides, alkylation can occur at positions 5, 7, 10, 11, 12, 13, 14, 16, 17, 18, 19, 20, 21, 24, 27, 28, 29, 30, 37, 38, 39, 40, 41, 42, or 43 (according to the amino acid numbering of wild type glucagon). Other nonlimiting examples with respect to glucagon related peptides (e.g. Class, 1, 2, 3, 4 or 5) include alkylation at position 10 (according to the amino acid numbering of wild type glucagon) and pegylation at one or more positions in the C-terminal portion of the glucagon related peptide, e.g., position 24, 28 or 29 (according to the amino acid numbering of wild type glucagon), within a C-terminal extension, or at the C-terminus (e.g., through adding a C-terminal Cys).

In a specific aspect of the invention, peptide Q (e.g. a glucagon superfamily peptide, a glucagon related peptide, a Class 1, 2, 3, 4 or 5 glucagon related peptide, or osteocalcin, calcitonin, amylin, or an analog, derivative or conjugate thereof) is modified to comprise an alkyl group by direct alkylation of an amine, hydroxyl, or thiol of a side chain of an amino acid of Q. In some embodiments, Q is directly alkylated through the side chain amine, hydroxyl, or thiol of an amino acid. In some embodiments, where Q is a glucagon related peptide, alkylation is at position 10, 20, 24, or 29

(according to the amino acid numbering of wild type glucagon). In this regard, the alkylated glucagon related peptide can comprise the amino acid sequence of SEQ ID NO: 1601, or a modified amino acid sequence thereof comprising one or more of the amino acid modifications described herein, with at least one of the amino acids at positions 10, 20, 24, and 29 (according to the amino acid numbering of wild type glucagon) modified to any amino acid comprising a side chain amine, hydroxyl, or thiol. In some specific embodiments of the invention, where Q is a glucagon related peptide, the direct alkylation of Q occurs through the side chain amine, hydroxyl, or thiol of the amino acid at position 10 (according to the amino acid numbering of wild type glucagon).

In some embodiments, the amino acid of peptide Q (e.g. a glucagon superfamily peptide, a glucagon related peptide, a Class 1, 2, 3, 4 or 5 glucagon related peptide, or osteocalcin, calcitonin, amylin, or an analog, derivative or conjugate thereof) comprising a side chain amine is an amino acid of Formula I. In some exemplary embodiments, the amino acid of Formula I, is the amino acid wherein n is 4 (Lys) or n is 3 (Orn).

In other embodiments, the amino acid of peptide Q comprising a side chain hydroxyl is an amino acid of Formula II. In some exemplary embodiments, the amino acid of Formula II is the amino acid wherein n is 1 (Ser).

In yet other embodiments, the amino acid of peptide Q comprising a side chain thiol is an amino acid of Formula III. In some exemplary embodiments, the amino acid of Formula II is the amino acid wherein n is 1 (Cys).

In yet other embodiments, the amino acid of peptide Q comprising a side chain amine, hydroxyl, or thiol is a disubstituted amino acid comprising the same structure of Formula I, Formula II, or Formula III, except that the hydrogen bonded to the alpha carbon of the amino acid of Formula I, Formula II, or Formula III is replaced with a second side chain.

In some embodiments of the invention, the alkylated peptide Q (e.g. a glucagon superfamily peptide, a glucagon related peptide, a Class 1, 2, 3, 4 or 5 glucagon related peptide, or osteocalcin, calcitonin, amylin, or an analog, derivative or conjugate thereof) comprises a spacer between the peptide and the alkyl group. In some embodiments, the Q is covalently bound to the spacer, which is covalently bound to the alkyl group. In some exemplary embodiments, peptide Q is modified to comprise an alkyl group by alkylation of an amine, hydroxyl, or thiol of a spacer, which spacer (where Q is a glucagon related peptide, e.g., Class 1, 2, 3, 4 or 5) is attached to a side chain of an amino acid at position 10, 20, 24, or 29 (according to the amino acid numbering of wild type glucagon) of Q. The amino acid of peptide Q to which the spacer is attached can be any amino acid comprising a moiety which permits linkage to the spacer. The amino acid of peptide Q to which the spacer is attached can be any amino acid (e.g., a singly α-substituted amino acid or an α,α-disubstituted amino acid) comprising a moiety which permits linkage to the spacer. An amino acid of peptide Q comprising a side chain —NH$_2$, —OH, or —COOH (e.g., Lys, Orn, Ser, Asp, or Glu) is suitable. In some embodiments where Q is a glucagon related peptide (e.g., Class 1, 2, 3, 4 or 5), the alkylated Q can comprise the amino acid sequence of SEQ ID NO: 1601, or a modified amino acid sequence thereof comprising one or more of the amino acid modifications described herein, with at least one of the amino acids at positions 10, 20, 24, and 29 (according to the amino acid numbering of wild type glucagon) modified to any amino acid comprising a side chain amine, hydroxyl, or carboxylate.

In some embodiments, the spacer between the peptide Q and the alkyl group is an amino acid comprising a side chain amine, hydroxyl, or thiol or a dipeptide or tripeptide comprising an amino acid comprising a side chain amine, hydroxyl, or thiol. In some embodiments, the amino acid spacer is not γ-Glu. In some embodiments, the dipeptide spacer is not γ-Glu-γ-Glu.

When alkylation occurs through an amine group of the amino acid of the spacer the alkylation can occur through the alpha amine of the amino acid or a side chain amine. In the instance in which the alpha amine is alkylated, the spacer amino acid can be any amino acid. For example, the spacer amino acid can be a hydrophobic amino acid, e.g., Gly, Ala, Val, Leu, Ile, Trp, Met, Phe, Tyr. Alternatively, the spacer amino acid can be an acidic residue, e.g., Asp and Glu. In exemplary embodiments, the spacer amino acid can be a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, 8-aminooctanoic acid. Alternatively, the spacer amino acid can be an acidic residue, e.g., Asp and Glu, provided that the alkylation occurs on the alpha amine of the acidic residue. In the instance in which the side chain amine of the spacer amino acid is alkylated, the spacer amino acid is an amino acid comprising a side chain amine, e.g., an amino acid of Formula I (e.g., Lys or Orn). In this instance, it is possible for both the alpha amine and the side chain amine of the spacer amino acid to be alkylated, such that the peptide is dialkylated. Embodiments of the invention include such dialkylated molecules.

When alkylation occurs through a hydroxyl group of the amino acid of the spacer, the amino acid or one of the amino acids of the spacer can be an amino acid of Formula II. In a specific exemplary embodiment, the amino acid is Ser.

When alkylation occurs through a thiol group of the amino acid of the spacer, the amino acid or one of the amino acids of the spacer can be an amino acid of Formula III. In a specific exemplary embodiment, the amino acid is Cys.

In some embodiments, the spacer comprises a hydrophilic bifunctional spacer. In a specific embodiment, the spacer comprises an amino poly(alkyloxy)carboxylate. In this regard, the spacer can comprise, for example, NH$_2$(CH$_2$CH$_2$O)$_n$(CH$_2$)$_m$COOH, wherein m is any integer from 1 to 6 and n is any integer from 2 to 12, such as, e.g., 8-amino-3,6-dioxaoctanoic acid, which is commercially available from Peptides International, Inc. (Louisville, Ky.).

In some embodiments, the spacer between peptide Q and the alkyl group is a hydrophilic bifunctional spacer. In certain embodiments, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate.

In some embodiments, the spacer between peptide Q and the alkyl group is a hydrophobic bifunctional spacer. In certain embodiments, the hydrophobic bifunctional spacer comprises two or more reactive groups, e.g., an amine, a hydroxyl, a thiol, and a carboxyl group or any combinations thereof. In certain embodiments, the hydrophobic bifunctional spacer comprises a hydroxyl group and a carboxylate. In other embodiments, the hydropholic bifunctional spacer comprises an amine group and a carboxylate. In other embodiments, the hydropholic bifunctional spacer comprises a thiol group and a carboxylate. Suitable hydrophobic bifunctional spacers comprising a carboxylate and a hydroxyl group or a thiol group are known in the art and include, for example, 8-hydroxyoctanoic acid and 8-mercaptooctanoic acid.

The spacer (e.g., amino acid, dipeptide, tripeptide, hydrophilic bifunctional spacer, or hydrophobic bifunctional spacer) in specific embodiments in which Q is a Class 1, Class 2, or Class 3 glucagon related peptide is 3 to 10 atoms (e.g., 6 to 10 atoms, (e.g., 6, 7, 8, 9, or 10 atoms)) in length. In more specific embodiments, the spacer attached to the Class 1, Class 2, or Class 3 glucagon related peptide is about 3 to 10 atoms (e.g., 6 to 10 atoms) in length and the alkyl is a C12 to C18 alkyl group, e.g., C14 alkyl group, C16 alkyl group, such that the total length of the spacer and alkyl group is 14 to 28 atoms, e.g., about 14, 15, 16, 17, 18, 19, 20, 21, 22, 23, 24, 25, 26, 27, or 28 atoms. In some embodiments in which Q is a Class 1, Class 2, or Class 3 glucagon related peptide, the length of the spacer and alkyl is 17 to 28 (e.g., 19 to 26, 19 to 21) atoms.

In accordance with certain foregoing embodiments in which Q is a Class 1, Class 2, or Class 3 glucagon related peptide, the bifunctional spacer can be a synthetic or non-naturally occurring amino acid comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer attached to the Class 1, Class 2, or Class 3 glucagon related peptide can be a dipeptide or tripeptide spacer having a peptide backbone that is 3 to 10 atoms (e.g., 6 to 10 atoms) in length. The dipeptide or tripeptide spacer attached to the Class 1, Class 2, or Class 3 glucagon related peptide can be composed of naturally-occurring and/or non-naturally occurring amino acids, including, for example, any of the amino acids taught herein. In some embodiments in which Q is a Class 1, Class 2, or Class 3 glucagon related peptide, the spacer comprises an overall negative charge, e.g., comprises one or two negatively charged amino acids. In some embodiments in which Q is a Class 1, Class 2, or Class 3 glucagon related peptide, the dipeptide spacer is selected from the group consisting of: Ala-Ala, β-Ala-β-Ala, Leu-Leu, Pro-Pro, γ-aminobutyric acid-γ-aminobutyric acid, and γGlu-γ-Glu. In some embodiments, the dipeptide spacer is not γ-Glu-γ-Glu.

Suitable methods of peptide alkylation via amines, hydroxyls, and thiols are known in the art. For example, a Williamson ether synthesis can be used to form an ether linkage between the glucagon related peptide and the alkyl group. Also, a nucleophilic substitution reaction of the peptide with an alkyl halide can result in any of an ether, thioether, or amino linkage.

The alkyl group of the alkylated peptide Q can be of any size, e.g., any length carbon chain, and can be linear or branched. In some embodiments of the invention, the alkyl group is a C4 to C30 alkyl. For example, the alkyl group can be any of a C4 alkyl, C6 alkyl, C8 alkyl, C10 alkyl, C12 alkyl, C14 alkyl, C16 alkyl, C18 alkyl, C20 alkyl, C22 alkyl, C24 alkyl, C26 alkyl, C28 alkyl, or a C30 alkyl. In some embodiments, the alkyl group is a C8 to C20 alkyl, e.g., a C14 alkyl or a C16 alkyl.

In some specific embodiments, the alkyl group comprises a steroid moiety of a bile acid, e.g., cholic acid, chenodeoxycholic acid, deoxycholic acid, lithocholic acid, taurocholic acid, glycocholic acid, and cholesterol acid.

In some embodiments of the invention, peptide Q is modified to comprise an alkyl group by reacting a nucleophilic, long chain alkane with Q, wherein Q comprises a leaving group suitable for nucleophilic substitution. In specific aspects, the nucleophilic group of the long chain alkane comprises an amine, hydroxyl, or thiol group (e.g. octadecylamine, tetradecanol, and hexadecanethiol). The leaving group of Q can be part of a side chain of an amino acid or can be part of the peptide backbone. Suitable leaving groups include, for example, N-hydroxysuccinimide, halogens, and sulfonate esters.

In certain embodiments, peptide Q is modified to comprise an alkyl group by reacting the nucleophilic, long chain alkane with a spacer, which is attached to Q, wherein the spacer comprises the leaving group. In specific aspects, the long chain alkane comprises an amine, hydroxyl, or thiol group. In certain embodiments, the spacer comprising the leaving group can be any spacer discussed herein, e.g., amino acids, dipeptides, tripeptides, hydrophilic bifunctional spacers and hydrophobic bifunctional spacers further comprising a suitable leaving group.

With regard to these aspects of the invention in which a long chain alkane is alkylated by peptide Q or the spacer, the long chain alkane may be of any size and can comprise any length of carbon chain. The long chain alkane can be linear or branched. In certain aspects, the long chain alkane is a C4 to C30 alkane. For example, the long chain alkane can be any of a C4 alkane, C6 alkane, C8 alkane, C10 alkane, C12 alkane, C14 alkane, C16 alkane, C18 alkane, C20 alkane, C22 alkane, C24 alkane, C26 alkane, C28 alkane, or a C30 alkane. In some embodiments in which the glucagon related peptide is a Class 1, Class 2, or Class 3 glucagon related peptide, the long chain alkane comprises a C8 to C20 alkane, e.g., a C14 alkane, C16 alkane, or a C18 alkane.

Also, in some embodiments alkylation can occur between Q and a cholesterol moiety. For example, the hydroxyl group of cholesterol can displace a leaving group on the long chain alkane to form a cholesterol-glucagon peptide product.

The alkylated peptides (Q) described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In some embodiments related to Class 1, 2, 3, 4 or 5 glucagon related peptides the alkylated Q can comprise SEQ ID NO: 1601, or a modified amino acid sequence thereof comprising one or more of the amino acid modifications described herein, in which at least one of the amino acids at position 10, 20, 24, and 29 (according to the amino acid numbering of wild type glucagon) comprise an alkyl group and at least one of the amino acids at position 16, 17, 21, 24, and 29, a position within a C-terminal extension or the C-terminal amino acid are modified to a Cys, Lys, Orn, homo-Cys, or Ac-Phe, and the side chain of the amino acid is covalently bonded to a hydrophilic moiety (e.g., PEG). In some embodiments related to Class 1, 2, 3, 4 or 5 glucagon related peptides, the alkyl group is attached to position 10 (according to the amino acid numbering of wild type glucagon), optionally via a spacer comprising Cys, Lys, Orn, homo-Cys, or Ac-Phe, and the hydrophilic moiety is incorporated at a Cys residue at position 24.

Alternatively, the alkylated peptide Q can comprise a spacer, wherein the spacer is both alkylated and modified to comprise the hydrophilic moiety. Nonlimiting examples of suitable spacers include a spacer comprising one or more amino acids selected from the group consisting of Cys, Lys, Orn, homo-Cys, and Ac-Phe.

Stabilization of the Alpha-Helix Structure

In some embodiments, an intramolecular bridge is formed between two amino acid side chains to stabilize the three dimensional structure of the carboxy terminal portion (e.g., amino acids 12-29 (according to the amino acid numbering of wild type glucagon)) of Class 1, 2, 3, 4, or 5 glucagon related peptide Q. The two amino acid side chains can be linked to one another through hydrogen-bonding, ionic interactions, such as the formation of salt bridges, or by covalent bonds.

In some embodiments, the intramolecular bridge is formed between two amino acids that are 3 amino acids apart, e.g., amino acids at positions i and i+4, wherein i is any integer between 12 and 25 (e.g., 12, 13, 14, 15, 16, 17, 18, 19, 20, 21, 22, 23, 24, and 25) according to the amino acid numbering of wild type glucagon. More particularly, the side chains of the amino acid pairs 12 and 16, 16 and 20, 20 and 24 or 24 and 28 (amino acid pairs in which i=12, 16, 20, or 24) according to the amino acid numbering of wild type glucagon are linked to one another and thus stabilize the glucagon alpha helix. Alternatively, i can be 17.

In some specific embodiments, wherein the amino acids at positions i and i+4 are joined by an intramolecular bridge, the size of the linker is about 8 atoms, or about 7-9 atoms.

In other embodiments, the intramolecular bridge is formed between two amino acids that are two amino acids apart, e.g., amino acids at positions j and j+3, wherein j is any integer between 12 and 26 (e.g., 12, 13, 14, 15, 16, 17, 18, 19, 20, 21, 22, 23, 24, 25, and 26) according to the amino acid numbering of wild type glucagon. In some specific embodiments, j is 17.

In some specific embodiments, wherein amino acids at positions j and j+3 are joined by an intramolecular bridge, the size of the linker is about 6 atoms, or about 5 to 7 atoms.

In yet other embodiments, the intramolecular bridge is formed between two amino acids that are 6 amino acids apart, e.g., amino acids at positions k and k+7, wherein k is any integer between 12 and 22 (e.g., 12, 13, 14, 15, 16, 17, 18, 19, 20, 21, and 22) according to the amino acid numbering of wild type glucagon. In some specific embodiments, k is 12, 13, or 17. In an exemplary embodiment, k is 17.

Examples of amino acid pairings that are capable of covalently bonding to form a six-atom linking bridge include Orn and Asp, Glu and an amino acid of Formula I, wherein n is 2, and homoglutamic acid and an amino acid of Formula I, wherein n is 1, wherein Formula I is:

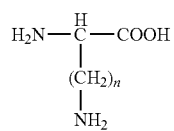

[Formula I]

wherein n = 1 to 4

Examples of amino acid pairing that are capable of covalently bonding to form a seven-atom linking bridge include Orn-Glu (lactam ring); Lys-Asp (lactam); or Homoser-Homoglu (lactone). Examples of amino acid pairings that may form an eight-atom linker include Lys-Glu (lactam); Homolys-Asp (lactam); Orn-Homoglu (lactam); 4-aminoPhe-Asp (lactam); or Tyr-Asp (lactone). Examples of amino acid pairings that may form a nine-atom linker include Homolys-Glu (lactam); Lys-Homoglu (lactam); 4-aminoPhe-Glu (lactam); or Tyr-Glu (lactone). Any of the side chains on these amino acids may additionally be substituted with additional chemical groups, so long as the three-dimensional structure of the alpha-helix is not disrupted. One of ordinary skill in the art can envision alternative pairings or alternative amino acid analogs, including chemically modified derivatives that would create a stabilizing structure of similar size and desired effect. For example, a homocysteine-homocysteine disulfide bridge is 6 atoms in length and may be further modified to provide the desired effect. Even without covalent linkage, the amino acid pairings described above or similar pairings that one of ordinary skill in the art can envision may also provide added stability to the alpha-helix through non-covalent bonds, for example, through formation of salt bridges or hydrogen-bonding interactions.

The size of a lactam ring can vary depending on the length of the amino acid side chains, and in some embodiments the lactam is formed by linking the side chains of a lysine amino acid to a glutamic acid side chain. Further exemplary embodiments (according to the amino acid numbering of wild type glucagon) include the following pairings, optionally with a lactam bridge: Glu at position 12 with Lys at position 16; native Lys at position 12 with Glu at position 16; Glu at position 16 with Lys at position 20; Lys at position 16 with Glu at position 20; Glu at position 20 with Lys at position 24; Lys at position 20 with Glu at position 24; Glu at position 24 with Lys at position 28; Lys at position 24 with Glu at position 28. Alternatively, the order of the amide bond in the lactam ring can be reversed (e.g., a lactam ring can be formed between the side chains of a Lys12 and a Glu16 or alternatively between a Glu 12 and a Lys16).

Intramolecular bridges other than a lactam bridge can be used to stabilize the alpha helix of Q. In some embodiments, the intramolecular bridge is a hydrophobic bridge. In this instance, the intramolecular bridge optionally is between the side chains of two amino acids that are part of the hydrophobic face of the alpha helix of Q. For example, one of the amino acids joined by the hydrophobic bridge can be the amino acid at position 10, 14, and 18 (according to the amino acid numbering of wild type glucagon).

In one specific aspect, olefin metathesis is used to cross-link one or two turns of the alpha helix of Q using an all-hydrocarbon cross-linking system. Q in this instance can comprise α-methylated amino acids bearing olefinic side chains of varying length and configured with either R or S stereochemistry at the i and i+4 or i+7 positions. For example, the olefinic side can comprise $(CH_2)_n$, wherein n is any integer between 1 to 6. In some embodiments, n is 3 for a cross-link length of 8 atoms. Suitable methods of forming such intramolecular bridges are described in the art. See, for example, Schafmeister et al., *J. Am. Chem. Soc.* 122: 5891-5892 (2000) and Walensky et al., *Science* 305: 1466-1470 (2004). Alternatively, Q can comprise O-allyl Ser residues located on adjacent helical turns, which are bridged together via ruthenium-catalyzed ring closing metathesis. Such procedures of cross-linking are described in, for example, Blackwell et al., *Angew, Chem., Int. Ed.* 37: 3281-3284 (1998).

In another specific aspect, use of the unnatural thio-dialanine amino acid, lanthionine, which has been widely adopted as a peptidomimetic of cystine, is used to cross-link one turn of the alpha helix. Suitable methods of lanthionine-based cyclization are known in the art. See, for instance, Matteucci et al., *Tetrahedron Letters* 45: 1399-1401 (2004); Mayer et al., *J. Peptide Res.* 51: 432-436 (1998); Polinsky et al., *J. Med. Chem.* 35: 4185-4194 (1992); Osapay et al., *J. Med. Chem.* 40: 2241-2251 (1997); Fukase et al., *Bull. Chem. Soc. Jpn.* 65: 2227-2240 (1992); Harpp et al., *J. Org. Chem.* 36: 73-80 (1971); Goodman and Shao, *Pure Appl. Chem.* 68: 1303-1308 (1996); and Osapay and Goodman, *J. Chem. Soc. Chem. Commun.* 1599-1600 (1993).

In some embodiments, α,ω-diaminoalkane tethers, e.g., 1,4-diaminopropane and 1,5-diaminopentane) between two Glu residues at positions i and i+7 are used to stabilize the alpha helix of Q. Such tethers lead to the formation of a bridge of 9-atoms or more in length, depending on the length of the diaminoalkane tether. Suitable methods of producing peptides cross-linked with such tethers are described in the art. See, for example, Phelan et al., *J. Am. Chem. Soc.* 119: 455-460 (1997).

In yet another embodiment of the invention, a disulfide bridge is used to cross-link one or two turns of the alpha helix of Q. Alternatively, a modified disulfide bridge in which one or both sulfur atoms are replaced by a methylene group resulting in an isosteric macrocyclization is used to stabilize the alpha helix of Q. Suitable methods of modifying peptides with disulfide bridges or sulfur-based cyclization are described in, for example, Jackson et al., *J. Am. Chem. Soc.* 113: 9391-9392 (1991) and Rudinger and Jost, *Experientia* 20: 570-571 (1964).

In yet another embodiment, the alpha helix of Q is stabilized via the binding of metal atom by two His residues or a His and Cys pair positioned at i and i+4. The metal atom can be, for example, Ru(III), Cu(II), Zn(II), or Cd(II). Such methods of metal binding-based alpha helix stabilization are known in the art. See, for example, Andrews and Tabor, *Tetrahedron* 55: 11711-11743 (1999); Ghadiri et al., *J. Am. Chem. Soc.* 112: 1630-1632 (1990); and Ghadiri et al., *J. Am. Chem. Soc.* 119: 9063-9064 (1997).

The alpha helix of Q can alternatively be stabilized through other means of peptide cyclizing, which means are reviewed in Davies, *J. Peptide. Sci.* 9: 471-501 (2003). The alpha helix can be stabilized via the formation of an amide bridge, thioether bridge, thioester bridge, urea bridge, carbamate bridge, sulfonamide bridge, and the like. For example, a thioester bridge can be formed between the C-terminus and the side chain of a Cys residue. Alternatively, a thioester can be formed via side chains of amino acids having a thiol (Cys) and a carboxylic acid (e.g., Asp, Glu). In another method, a cross-linking agent, such as a dicarboxylic acid, e.g. suberic acid (octanedioic acid), etc. can introduce a link between two functional groups of an amino acid side chain, such as a free amino, hydroxyl, thiol group, and combinations thereof.

In accordance with some embodiments, the alpha helix of Q is stabilized through the incorporation of hydrophobic amino acids at positions i and i+4. For instance, i can be Tyr and i+4 can be either Val or Leu; i can be Phe and i+4 can be Cys or Met; I can be Cys and i+4 can be Met; or i can be Phe and i+4 can be Ile. It should be understood that, for purposes herein, the above amino acid pairings can be reversed, such that the indicated amino acid at position i could alternatively be located at i+4, while the i+4 amino acid can be located at the i position.

In accordance with other embodiments of the invention, wherein Q is a glucagon related peptide, the alpha helix is stabilized through incorporation (either by amino acid substitution or insertion) of one or more alpha helix-stabilizing amino acids at the C-terminal portion of Q (around amino acids 12-29 according to the numbering of the amino acid numbering of wild type glucagon). In a specific embodiment, the alpha helix-stabilizing amino acid is an α,α-disubstituted amino acid, including, but not limited to any of amino isobutyric acid (Aib), an amino acid disubstituted with the same or a different group selected from methyl, ethyl, propyl, and n-butyl, or with a cyclooctane or cycloheptane (e.g., 1-aminocyclooctane-1-carboxylic acid). In some embodiments, one, two, three, four or more of positions 16, 17, 18, 19, 20, 21, 24 or 29 of the glucagon related peptide is substituted with an α,α-disubstituted amino acid. In a specific embodiment, one, two, three or all of positions 16, 20, 21, and 24 are substituted with Aib.

Conjugates

In some embodiments, the peptides (Q) described herein are glycosylated, amidated, carboxylated, phosphorylated, esterified, N-acylated, cyclized via, e.g., a disulfide bridge, or converted into a salt (e.g., an acid addition salt, a basic addition salt), and/or optionally dimerized, multimerized, or polymerized, or conjugated. As described herein, Q can be a glucagon superfamily peptide, glucagon related peptide, including a Class 1, 2, 3, 4 or 5 glucagon related peptide, or osteocalcin, calcitonin, amylin, or an analog, derivative or conjugate thereof.

The present disclosure also encompasses conjugates in which Q of Q-L-Y is further linked to a heterologous moiety. The conjugation between Q and the heterologous moiety can be through covalent bonding, non-covalent bonding (e.g. electrostatic interactions, hydrogen bonds, van der Waals interactions, salt bridges, hydrophobic interactions, and the like), or both types of bonding. A variety of non-covalent coupling systems may be used, including biotin-avidin, ligand/receptor, enzyme/substrate, nucleic acid/nucleic acid binding protein, lipid/lipid binding protein, cellular adhesion molecule partners; or any binding partners or fragments thereof which have affinity for each other. In some aspects, the covalent bonds are peptide bonds. The conjugation of Q to the heterologous moiety may be indirect or direct conjugation, the former of which may involve a linker or spacer. Suitable linkers and spacers are known in the art and include, but not limited to, any of the linkers or spacers described herein under the sections "Acylation and alkylation" and "The Linking Group," and in the subsection "Chemical Modification of Q and/or L."

As used herein, the term "heterologous moiety" is synonymous with the term "conjugate moiety" and refers to any molecule (chemical or biochemical, naturally-occurring or non-coded) which is different from Q to which it is attached. Exemplary conjugate moieties that can be linked to Q include but are not limited to a heterologous peptide or polypeptide (including for example, a plasma protein), a targeting agent, an immunoglobulin or portion thereof (e.g., variable region, CDR, or Fc region), a diagnostic label such as a radioisotope, fluorophore or enzymatic label, a polymer including water soluble polymers, or other therapeutic or diagnostic agents. In some embodiments a conjugate is provided comprising Q and a plasma protein, wherein the plasma protein is selected from the group consisting of albumin, transferin, fibrinogen and globulins. In some embodiments the plasma protein moiety of the conjugate is albumin or transferin. The conjugate in some embodiments comprises Q and one or more of a polypeptide, a nucleic acid molecule, an antibody or fragment thereof, a polymer, a quantum dot, a small molecule (molecular weight less than 1000 daltons), a toxin, a diagnostic agent, a carbohydrate, an amino acid.

C-Terminal Heterologous Moiety

In some embodiments, the heterologous moiety conjugated to Q is a peptide which is distinct from Q and the conjugate is a fusion peptide or a chimeric peptide. In some embodiments, where Q is a glucagon superfamily peptide, the heterologous moiety is a peptide extension of 1-21 amino acids. In specific embodiments, where Q is a glucagon related peptide (e.g. a Class 1, 2, 3, 4 or 5 glucagon related peptide), the extension is attached to the C-terminus of Q, e.g., to amino acid at position 29. In some embodiments, the extension comprises an amino acid sequence of SEQ ID NO: 1610 (GPSSGAPPPS), SEQ ID NO: 1611 (GGPSSGAPPPS-CONH$_2$), SEQ ID NO: 1614 (KRNRNNIA), SEQ ID NO: 1643 (KRNR), or KGKKNDWKHNITQ (SEQ ID NO: 1613). In specific aspects, the amino acid sequence is attached through the C-terminal amino acid of Q, e.g., amino acid at position 29. In some embodiments, the amino acid sequence of SEQ ID NOs: 1610, 1611, 1613, 1614 and 1643 is bound to amino acid 29 of the peptide through a peptide bond. In some specific embodiments, the amino acid at position 29 of the glucagon related peptide (e.g. a Class 1, 2, 3, 4 or 5 glucagon related peptide) is a Gly and the Gly is fused to one of the amino acid sequences of SEQ ID NOs: 1610, 1611, 1613, 1614 and 1643.

Polymer Heterologous Moiety

In some embodiments, the heterologous moiety conjugated to Q is a polymer. In some embodiments, the polymer is selected from the group consisting of: polyamides, polycarbonates, polyalkylenes and derivatives thereof including, polyalkylene glycols, polyalkylene oxides, polyalkylene terepthalates, polymers of acrylic and methacrylic esters, including poly(methyl methacrylate), poly(ethyl methacrylate), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

In some aspects, the polymer is a biodegradable polymer, including a synthetic biodegradable polymer (e.g., polymers of lactic acid and glycolic acid, polyanhydrides, poly(ortho) esters, polyurethanes, poly(butic acid), poly(valeric acid), and poly(lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

In some aspects, the polymer is a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly(isobutyl methacrylate), poly(hexylmethacrylate), poly (isodecyl methacrylate), poly(lauryl methacrylate), poly (phenyl methacrylate), poly(methyl acrylate), poly(isopropyl acrylate), poly(isobutyl acrylate), and poly(octadecyl acrylate).

In some embodiments, the polymer is a water-soluble polymer or a hydrophilic polymer. Hydrophilic polymers are further described herein under "Hydrophilic Heterologous Moieties." Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene co-polymer, polyoxyethyleneglycols, polyethylene oxide, and derivatives, salts, and combinations thereof.

In specific embodiments, the polymer is a polyalkylene glycol, including, for example, polyethylene glycol (PEG).

In some embodiments, the heterologous moiety is a carbohydrate. In some embodiments, the carbohydrate is a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

In some embodiments, the heterologous moiety is a lipid. The lipid, in some embodiments, is a fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide, oil, wax, cholesterol, sterol, fat-soluble vitamin, monoglyceride, diglyceride, triglyceride, a phospholipid.

Fc Fusion Heterologous Moiety

As noted above, in some embodiments Q is conjugated, e.g., fused to an immunoglobulin or portion thereof (e.g. variable region, CDR, or Fc region). As described herein, Q can be a glucagon superfamily peptide, glucagon related peptide, including a Class 1, 2, 3, 4 or 5 glucagon related peptide, or osteocalcin, calcitonin, amylin, or an analog, derivative or conjugate thereof. Known types of immunoglobulins (Ig) include IgG, IgA, IgE, IgD or IgM. The Fc region is a C-terminal region of an Ig heavy chain, which is responsible for binding to Fc receptors that carry out activities such as recycling (which results in prolonged half-life), antibody dependent cell-mediated cytotoxicity (ADCC), and complement dependent cytotoxicity (CDC).

For example, according to some definitions the human IgG heavy chain Fc region stretches from Cys226 to the C-terminus of the heavy chain. The "hinge region" generally extends from Glu216 to Pro230 of human IgG1 (hinge regions of other IgG isotypes may be aligned with the IgG1 sequence by aligning the cysteines involved in cysteine bonding). The Fc region of an IgG includes two constant domains, CH2 and CH3. The CH2 domain of a human IgG Fc region usually extends from amino acids 231 to amino acid 341. The CH3 domain of a human IgG Fc region usually extends from amino acids 342 to 447. References made to amino acid numbering of immunoglobulins or immunoglobulin fragments, or regions, are all based on Kabat et al. 1991, Sequences of Proteins of Immunological Interest, U.S. Department of Public Health, Bethesda, Md. In a related embodiment, the Fc region may comprise one or more native or modified constant regions from an immunoglobulin heavy chain, other than CH1, for example, the CH2 and CH3 regions of IgG and IgA, or the CH3 and CH4 regions of IgE.

Suitable conjugate moieties include portions of immunoglobulin sequence that include the FcRn binding site. FcRn, a salvage receptor, is responsible for recycling immunoglobulins and returning them to circulation in blood. The region of the Fc portion of IgG that binds to the FcRn receptor has been described based on X-ray crystallography (Burmeister et al. 1994, Nature 372:379). The major contact area of the Fc with the FcRn is near the junction of the CH2 and CH3 domains. Fc-FcRn contacts are all within a single Ig heavy chain. The major contact sites include amino acid residues 248, 250-257, 272, 285, 288, 290-291, 308-311, and 314 of the CH2 domain and amino acid residues 385-387, 428, and 433-436 of the CH3 domain.

Some conjugate moieties may or may not include FcγR binding site(s). FcγR are responsible for ADCC and CDC. Examples of positions within the Fc region that make a direct contact with FcγR are amino acids 234-239 (lower hinge region), amino acids 265-269 (B/C loop), amino acids 297-299 (C'/E loop), and amino acids 327-332 (F/G) loop (Sondermann et al., Nature 406: 267-273, 2000). The lower hinge region of IgE has also been implicated in the FcRI binding (Henry, et al., Biochemistry 36, 15568-15578, 1997). Residues involved in IgA receptor binding are described in Lewis et al., (J Immunol. 175:6694-701, 2005) Amino acid residues involved in IgE receptor binding are described in Sayers et al. (J Biol Chem. 279(34):35320-5, 2004).

Amino acid modifications may be made to the Fc region of an immunoglobulin. Such variant Fc regions comprise at least one amino acid modification in the CH3 domain of the Fc region (residues 342-447) and/or at least one amino acid modification in the CH2 domain of the Fc region (residues 231-341). Mutations believed to impart an increased affinity for FcRn include T256A, T307A, E380A, and N434A (Shields et al. 2001, J. Biol. Chem. 276:6591). Other mutations may reduce binding of the Fc region to FcγRI, FcγRIIA, FcγRIIB, and/or FcγRIIIA without significantly reducing affinity for FcRn. For example, substitution of the Asn at position 297 of the Fc region with Ala or another amino acid removes a highly conserved N-glycosylation site and may result in reduced immunogenicity with concomitant prolonged half-life of the Fc region, as well as reduced binding to FcγRs (Routledge et al. 1995, Transplantation 60:847; Friend et al. 1999, Transplantation 68:1632; Shields et al. 1995, J. Biol. Chem. 276:6591) Amino acid modifications at positions 233-236 of IgG1 have been made that reduce binding to FcγRs (Ward and Ghetie 1995, Therapeutic Immunology 2:77 and Armour et al. 1999, Eur. J. Immunol. 29:2613). Some exemplary amino acid substitutions are described in U.S. Pat. Nos. 7,355,008 and 7,381,408, each incorporated by reference herein in its entirety.

Hydrophilic Heterologous Moiety

In some embodiments, Q described herein is covalently bonded to a hydrophilic moiety. As described herein, Q can be a glucagon superfamily peptide, glucagon related peptide, including a Class 1, 2, 3, 4 or 5 glucagon related peptide, or osteocalcin, calcitonin, amylin, or an analog, derivative or conjugate thereof. Hydrophilic moieties can be attached to Q under any suitable conditions used to react a protein with an activated polymer molecule. Any means known in the art can be used, including via acylation, reductive alkylation, Michael addition, thiol alkylation or other chemoselective conjugation/ligation methods through a reactive group on the PEG moiety (e.g., an aldehyde, amino, ester, thiol, α-haloacetyl, maleimido or hydrazino group) to a reactive group on the target compound (e.g., an aldehyde, amino, ester, thiol, α-haloacetyl, maleimido or hydrazino group). Activating groups which can be used to link the water soluble polymer to one or more proteins include without limitation sulfone, maleimide, sulfhydryl, thiol, triflate, tresylate, azidirine, oxirane, 5-pyridyl, and alpha-halogenated acyl group (e.g., alpha-iodo acetic acid, alpha-bromoacetic acid, alpha-chloroacetic acid). If attached to the peptide by reductive alkylation, the polymer selected should have a single reactive aldehyde so that the degree of polymerization is controlled. See, for example, Kinstler et al., Adv. Drug. Delivery Rev. 54: 477-485 (2002); Roberts et al., Adv. Drug Delivery Rev. 54: 459-476 (2002); and Zalipsky et al., Adv. Drug Delivery Rev. 16: 157-182 (1995).

Further activating groups which can be used to link the hydrophilic moiety (water soluble polymer) to a protein include an alpha-halogenated acyl group (e.g., alpha-iodo acetic acid, alpha-bromoacetic acid, alpha-chloroacetic acid). In specific aspects, an amino acid residue of the peptide having a thiol is modified with a hydrophilic moiety such as PEG. In some embodiments, an amino acid on Q comprising a thiol is modified with maleimide-activated PEG in a Michael addition reaction to result in a PEGylated peptide comprising the thioether linkage shown below:

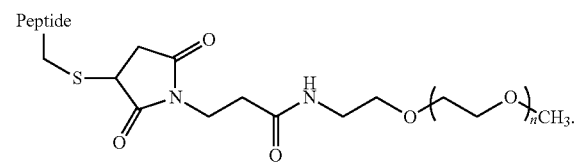

In some embodiments, the thiol of an amino acid of Q is modified with a haloacetyl-activated PEG in a nucleophilic substitution reaction to result in a PEGylated peptide comprising the thioether linkage shown below:

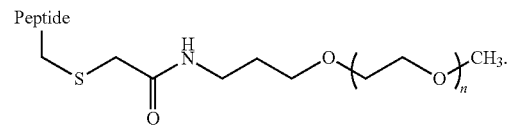

Suitable hydrophilic moieties include polyethylene glycol (PEG), polypropylene glycol, polyoxyethylated polyols (e.g., POG), polyoxyethylated sorbitol, polyoxyethylated glucose, polyoxyethylated glycerol (POG), polyoxyalkylenes, polyethylene glycol propionaldehyde, copolymers of ethylene glycol/propylene glycol, monomethoxy-polyethylene glycol, mono-(C1-C10) alkoxy- or aryloxy-polyethylene glycol, carboxymethylcellulose, polyacetals, polyvinyl alcohol (PVA), polyvinyl pyrrolidone, poly-1,3-dioxolane, poly-1,3,6-trioxane, ethylene/maleic anhydride copolymer, poly (.beta.-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, colonic acids or other polysaccharide polymers, Ficoll or dextran and mixtures thereof. Dextrans are polysaccharide polymers of glucose subunits, predominantly linked by al-6 linkages. Dextran is available in many molecular weight ranges, e.g., about 1 kD to about 100 kD, or from about 5, 10, 15 or 20 kD to about 20, 30, 40, 50, 60, 70, 80 or 90 kD.

The hydrophilic moiety, e.g., polyethylene glycol chain, in accordance with some embodiments has a molecular weight selected from the range of about 500 to about 40,000 Daltons. In some embodiments the polyethylene glycol chain has a molecular weight selected from the range of about 500 to about 5,000 Daltons, or about 1,000 to about 5,000 Daltons. In another embodiment the hydrophilic moiety, e.g., polyethylene glycol chain, has a molecular weight of about 10,000 to about 20,000 Daltons. In yet other exemplary embodiments the hydrophilic moiety, e.g. polyethylene glycol chain, has a molecular weight of about 20,000 to about 40,000 Daltons.

Linear or branched hydrophilic polymers are contemplated. Resulting preparations of conjugates may be essentially monodisperse or polydisperse, and may have about 0.5, 0.7, 1, 1.2, 1.5 or 2 polymer moieties per peptide.

In some embodiments, the native amino acid of the peptide is substituted with an amino acid having a side chain suitable for crosslinking with hydrophilic moieties, to facilitate linkage of the hydrophilic moiety to the peptide. Exemplary amino acids include Cys, Lys, Orn, homo-Cys, or acetyl phenylalanine (Ac-Phe). In other embodiments, an amino acid modified to comprise a hydrophilic group is added to the peptide at the C-terminus In some embodiments, the peptide of the conjugate is conjugated to a hydrophilic moiety, e.g. PEG, via covalent linkage between a side chain of an amino acid of the peptide and the hydrophilic moiety. In some embodiments, where Q is a Class 1, 2, 3, 4 or 5 glucagon-related peptide, the peptide is conjugated to a hydrophilic moiety via the side chain of an amino acid at position 16, 17, 21, 24, 29, 40, a position within a C-terminal extension, or the C-terminal amino acid, or a combination of these positions. In some aspects, the amino acid covalently linked to a hydrophilic moiety (e.g., the amino acid comprising a hydrophilic moiety) is a Cys, Lys, Orn, homo-Cys, or Ac-Phe, and the side chain of the amino acid is covalently bonded to a hydrophilic moiety (e.g., PEG).

rPEG Heterologous Moiety

In some embodiments, the conjugate of the invention comprises a Q fused to an accessory peptide which is capable of forming an extended conformation similar to chemical PEG (e.g., a recombinant PEG (rPEG) molecule), such as those described in International Patent Application Publication No. WO2009/023270 and U.S. Patent Application Publication No. US2008/0286808. The rPEG molecule is not polyethylene glycol. The rPEG molecule in some aspects is a polypeptide comprising one or more of glycine, serine, glutamic acid, aspartic acid, alanine, or proline. In some aspects, the rPEG is a homopolymer, e.g., poly-glycine, poly-serine, poly-glutamic acid, poly-aspartic acid, poly-alanine, or poly-proline. In other embodiments, the rPEG comprises two types of amino acids repeated, e.g., poly(Gly-Ser), poly(Gly-Glu), poly(Gly-Ala), poly(Gly-Asp), poly(Gly-Pro), poly(Ser-Glu), etc. In some aspects, the rPEG comprises three different types of amino acids, e.g., poly(Gly-Ser-Glu). In specific aspects, the rPEG increases the half-life of Q. In some aspects, the rPEG comprises a net positive or net negative charge. The rPEG in some aspects lacks secondary structure. In some embodiments, the rPEG is greater than or equal to 10 amino acids in length and in some embodiments is about 40 to about 50 amino acids in length. The accessory peptide in some aspects is fused to the N- or C-terminus of the peptide of the invention through a peptide bond or a proteinase cleavage site, or is inserted into the loops of the peptide of the invention. The rPEG in some aspects comprises an affinity tag or is linked to a PEG that is greater than 5 kDa. In some embodiments, the rPEG confers the conjugate of the invention with an increased hydrodynamic radius, serum half-life, protease resistance, or solubility and in some aspects confers the conjugate with decreased immunogenicity.

Q can be linked to conjugate moieties via direct covalent linkage by reacting targeted amino acid residues of the peptide with an organic derivatizing agent that is capable of reacting with selected side chains or the N- or C-terminal residues of these targeted amino acids. Reactive groups on the peptide or conjugate moiety include, e.g., an aldehyde, amino, ester, thiol, α-haloacetyl, maleimido or hydrazino group. Derivatizing agents include, for example, maleimidobenzoyl sulfosuccinimide ester (conjugation through cysteine residues), N-hydroxysuccinimide (through lysine residues), glutaraldehyde, succinic anhydride or other agents known in the art. Alternatively, the conjugate moieties can be linked to the peptide indirectly through intermediate carriers, such as polysaccharide or polypeptide carriers. Examples of polysaccharide carriers include aminodextran. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier.

Multimers

With regard to the Class 1, Class 2, and Class 3 glucagon related peptides, Q may be part of a dimer, trimer or higher order multimer comprising at least two, three, or more peptides bound via a linker, wherein at least one or both peptides is a glucagon related peptide. The dimer may be a homodimer or heterodimer. In some embodiments, the linker is selected from the group consisting of a bifunctional thiol crosslinker and a bi-functional amine crosslinker. In certain embodiments, the linker is PEG, e.g., a 5 kDa PEG, 20 kDa PEG. In some embodiments, the linker is a disulfide bond. For example, each monomer of the dimer may comprise a Cys residue (e.g., a terminal or internally positioned Cys) and the sulfur atom of each Cys residue participates in the formation of the disulfide bond. In some aspects of the invention, the monomers are connected via terminal amino acids (e.g., N-terminal or C-terminal), via internal amino acids, or via a terminal amino acid of at least one monomer and an internal amino acid of at least one other monomer. In specific aspects, the monomers are not connected via an N-terminal amino acid. In some aspects, the monomers of the multimer are attached together in a "tail-to-tail" orientation in which the C-terminal amino acids of each monomer are attached together. A conjugate moiety may be covalently linked to any of the glucagon related peptides described herein, including a dimer, trimer or higher order multimer.

Conjugation of the Heterologous Moiety to Q

The heterologous moiety is conjugated to peptide (Q) according to linkage and conjugation methods described in the "Linking Group" section and "Chemical Modification of Q and/or Y subsection."

Methods for Making Q

The peptides (Q) disclosed herein may be prepared by standard synthetic methods, recombinant DNA techniques, or any other methods of preparing peptides and fusion proteins. Although certain non-natural amino acids cannot be expressed by standard recombinant DNA techniques, techniques for their preparation are known in the art. Compounds of this invention that encompass non-peptide portions may be synthesized by standard organic chemistry reactions, in addition to standard peptide chemistry reactions when applicable.

The peptides of the disclosure can be obtained by methods known in the art. Suitable methods of de novo synthesizing peptides are described in, for example, Chan et al., *Fmoc Solid Phase Peptide Synthesis*, Oxford University Press, Oxford, United Kingdom, 2005; *Peptide and Protein Drug Analysis*, ed. Reid, R., Marcel Dekker, Inc., 2000; *Epitope*

*Mapping*, ed. Westwood et al., Oxford University Press, Oxford, United Kingdom, 2000; and U.S. Pat. No. 5,449,752.

Also, in the instances in which the peptides of the disclosure do not comprise any non-coded or non-natural amino acids, the peptide can be recombinantly produced using a nucleic acid encoding the amino acid sequence of the peptide using standard recombinant methods. See, for instance, Sambrook et al., *Molecular Cloning: A Laboratory Manual*. 3rd ed., Cold Spring Harbor Press, Cold Spring Harbor, N.Y. 2001; and Ausubel et al., *Current Protocols in Molecular Biology*, Greene Publishing Associates and John Wiley & Sons, NY, 1994.

In some embodiments, the peptides of the disclosure are isolated. In some embodiments, the peptides of the disclosure are purified. It is recognized that "purity" is a relative term, and not to be necessarily construed as absolute purity or absolute enrichment or absolute selection. In some aspects, the purity is at least or about 50%, is at least or about 60%, at least or about 70%, at least or about 80%, or at least or about 90% (e.g., at least or about 91%, at least or about 92%, at least or about 93%, at least or about 94%, at least or about 95%, at least or about 96%, at least or about 97%, at least or about 98%, at least or about 99% or is approximately 100%.

In some embodiments, the peptides described herein are commercially synthesized by companies, such as Synpep (Dublin, Calif.), Peptide Technologies Corp. (Gaithersburg, Md.), and Multiple Peptide Systems (San Diego, Calif.). In this respect, the peptides can be synthetic, recombinant, isolated, and/or purified.

Classes of glucagon related peptides (Q) are described in detail below. With respect to each of the sections of disclosure concerning Class 1, Class 2, Class 3, Class 4, and Class 5 glucagon related peptides, modifications are described with respect to the glucagon related peptide portion (Q) of a Q-L-Y conjugate detailed above. Thus, structural elements described with regard to a class of glucagon related peptides are structural elements of Q which is then further modified to generate the Q-L-Y conjugate as described above.

Class 1 Glucagon Related Peptides

In certain embodiments, the glucagon related peptide is a Class 1 glucagon related peptide, which is described herein and in International Patent Publication No. WO 2009/155257 (published on Dec. 23, 2009), International Patent Application Publication No. WO 2008/086086 (published on Jul. 17, 2008), and International Patent Application Publication No. WO 2007/056362 (published on May 18, 2007), the contents of which are incorporated by reference in their entirety.

The biological sequences referenced in the following section (SEQ ID NOs: 801-915) relating to Class 1 glucagon related peptides correspond to SEQ ID NOs: 1-115 in International International Patent Publication No. WO 2009/155257.

Activity

Class 1 glucagon peptides retain glucagon receptor activity relative to the native glucagon peptide (SEQ ID NO: 801). For example, the glucagon peptide can retain at least 10%, 20%, 30%, 40%, 50%, 60%, 70%, 75% activity, 80% activity, 85% activity, or 90% of the activity of native glucagon (calculated as the inverse ratio of $EC_{50}$s for the glucagon peptide vs. glucagon, e.g., as measured by cAMP production using the assay generally described in Example 2). In some embodiments, the Class 1 glucagon related peptides have the same or greater activity (used synonymously with the term "potency" herein) than glucagon. In some embodiments, the glucagon peptides described herein exhibit no more than about 100%, 1000%, 10,000%, 100,000%, or 1,000,000% of the activity of native glucagon peptide.

Any of the Class 1 glucagon related peptides described herein may exhibit an $EC_{50}$ at the human glucagon receptor of about 100 nM, 75 nM, 50 nM, 40 nM, 30 nM, 20 nM, 10 nM, 5 nM, 1 nM or less when tested for cAMP induction in HEK293 cells over-expressing glucagon receptor, e.g. using the assay of Example 2. Typically pegylated peptides will exhibit a higher $EC_{50}$ compared to the unpegylated peptide. For example, the Class 1 glucagon related peptides described herein, when unpegylated, may exhibit activity at the glucagon receptor which is at least 20% (e.g., at least 30%, at least 40%, at least 50%, at least 60%, at least 75%, at least 80%, at least 90% at least 95%, at least 98%, at least 99%, 100%, 150%, 200%, 400%, 500% or more) of the activity of native glucagon (SEQ ID NO: 801) at the glucagon receptor. In certain embodiments, the Class 1 glucagon related peptides described herein exhibit the indicated % activity of native glucagon at the glucagon receptor, when lacking a hydrophilic moiety, but exhibit a decreased % activity of native glucagon at the glucagon receptor, when comprising a hydrophilic moiety. For example, the Class 1 glucagon related peptides described herein, when pegylated, may exhibit activity at the glucagon receptor which is at least 2% (e.g. at least 3%, at least 4%, at least 5%, at least 6%, at least 7%, at least 8%, at least 9%, or at least 10% of the activity of native glucagon. In some embodiments, the Class 1 glucagon related peptides described herein may exhibit any of the above indicated activities but no more than 1000%, 10,000%, 100,000%, or 1,000,000% of the activity of native glucagon at the glucagon receptor.

In some embodiments, the Class 1 glucagon related peptides exhibit less than about 5%, 4%, 3%, 2% or 1% of the activity of native GLP-1 at the GLP-1 receptor and/or a greater than about 5-fold, 10-fold, or 15-fold selectivity for glucagon receptor compared to GLP-1 receptor. For example, in some embodiments, the Class 1 glucagon related peptides exhibit less than 5% of the activity of native GLP-1 at the GLP-1 receptor and exhibit a greater than 5-fold selectivity for glucagon receptor compared to GLP-1 receptor.

Improved Solubility

Native glucagon exhibits poor solubility in aqueous solution, particularly at physiological pH, with a tendency to aggregate and precipitate over time. In contrast, the Class 1 glucagon related peptides in some embodiments exhibit at least 2-fold, 5-fold, or even higher solubility compared to native glucagon at a pH between 6 and 8, or between 6 and 9, for example, at pH 7 after 24 hours at 25° C.

Accordingly, in some embodiments, a Class 1 glucagon related peptide has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 801) to improve the peptides solubility in aqueous solutions, particularly at a pH ranging from about 5.5 to about 8.0, while retaining the native peptide's biological activity.

For example, the solubility of any of the Class 1 glucagon related peptides described herein can be further improved by attaching a hydrophilic moiety to the peptide. Introduction of such groups also increases duration of action, e.g. as measured by a prolonged half-life in circulation. Hydrophilic moieties are further described herein.

Modification with Charged Residues

In some embodiments, solubility is improved by adding charge to the Class 1 glucagon related peptide by the substitution of native non-charged amino acids with charged amino acids selected from the group consisting of lysine, arginine, histidine, aspartic acid and glutamic acid, or by the addition of charged amino acids to the amino or carboxy terminus of the peptide.

In accordance with some embodiments, the Class 1 glucagon related peptide has improved solubility due to the fact that the peptide is modified by amino acid substitutions and/or additions that introduce a charged amino acid into the C-terminal portion of the peptide, and in some embodiments at a position C-terminal to position 27 of SEQ ID NO: 801. Optionally, one, two or three charged amino acids may be introduced within the C-terminal portion, and in some embodiments C-terminal to position 27. In accordance with some embodiments, the native amino acid(s) at positions 28 and/or 29 are substituted with a charged amino acid, and/or one to three charged amino acids are added to the C-terminus of the peptide, e.g. after position 27, 28 or 29. In exemplary embodiments, one, two, three or all of the charged amino acids are negatively charged. In other embodiments, one, two, three or all of the charged amino acids are positively charged.

In specific exemplary embodiments, the Class 1 glucagon related peptide may comprise any one or two of the following modifications: substitution of N28 with E; substitution of N28 with D; substitution of T29 with D; substitution of T29 with E; insertion of E after position 27, 28 or 29; insertion of D after position 27, 28 or 29. For example, D28E29, E28E29, E29E30, E28E30, D28E30.

In accordance with one exemplary embodiment, the Class 1 glucagon related peptide comprises an amino acid sequence of SEQ ID NO: 811, or an analog thereof that contains 1 to 3 further amino acid modifications (described herein in reference to glucagon agonists) relative to native glucagon, or a glucagon agonist analog thereof. SEQ ID NO: 811 represents a modified Class 1 glucagon related peptide, wherein the asparagine residue at position 28 of the native protein has been substituted with an aspartic acid. In another exemplary embodiment the Class 1 glucagon related peptide comprises an amino acid sequence of SEQ ID NO: 838, wherein the asparagine residue at position 28 of the native protein has been substituted with glutamic acid. Other exemplary embodiments include Class 1 glucagon related peptides of SEQ ID NOs: 824, 825, 826, 833, 835, 836 and 837.

Substituting the normally occurring amino acid at position 28 and/or 29 with charged amino acids, and/or the addition of one to two charged amino acids at the carboxy terminus of the Class 1 glucagon related peptide, enhances the solubility and stability of the glucagon peptides in aqueous solutions at physiologically relevant pHs (i.e., a pH of about 6.5 to about 7.5) by at least 5-fold and by as much as 30-fold. Accordingly, Class 1 glucagon peptides of some embodiments retain glucagon activity and exhibit at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

Additional modifications, e.g. conservative substitutions, which modifications are further described herein, may be made to the Class 1 glucagon related peptide that still allow it to retain glucagon activity.

Improved Stability

Any of the Class 1 glucagon peptides may additionally exhibit improved stability and/or reduced degradation, for example, retaining at least 95% of the original peptide after 24 hours at 25° C. Any of the Class 1 glucagon related peptides disclosed herein may additionally exhibit improved stability at a pH within the range of 5.5 to 8, for example, retaining at least 75%, 80%, 90%, 95%, 96%, 97%, 98% or 99% of the original peptide after 24 hours at 25° C. In some embodiments, the Class 1 glucagon related peptides of the invention exhibit improved stability, such that at least 75% (e.g., at least 80%, at least 85%, at least 90%, at least 95%, more than 95%, up to 100%) of a concentration of the peptide or less than about 25% (e.g., less than 20%, less than 15%, less than 10%, less than 5%, 4%, 3%, 2%, 1%, down to 0%) of degraded peptide is detectable at 280 nm by an ultraviolet (UV) detector after about 1 or more weeks (e.g., about 2 weeks, about 4 weeks, about 1 month, about two months, about four months, about six months, about eight months, about ten months, about twelve months) in solution at a temperature of at least 20° C. (e.g., 21° C., 22° C., 23° C., 24° C., 25° C., 26° C., at least 27.5° C., at least 30° C., at least 35° C., at least 40° C., at least 50° C.) and less than 100° C., less than 85° C., less than 75° C., or less than 70° C. The Class 1 glucagon related peptides may include additional modifications that alter its pharmaceutical properties, e.g. increased potency, prolonged half-life in circulation, increased shelf-life, reduced precipitation or aggregation, and/or reduced degradation, e.g., reduced occurrence of cleavage or chemical modification after storage.

In yet further exemplary embodiments, any of the foregoing Class 1 glucagon related peptides can be further modified to improve stability by modifying the amino acid at position 15 of SEQ ID NO: 801 to reduce degradation of the peptide over time, especially in acidic or alkaline buffers. In exemplary embodiments, Asp at position 15 is substituted with a Glu, homo-Glu, cysteic acid, or homo-cysteic acid.

Alternatively, any of the Class 1 glucagon related peptides described herein can be further modified to improve stability by modifying the amino acid at position 16 of SEQ ID NO: 801. In exemplary embodiments, Ser at position 16 is substituted with Thr or Aib, or any of the amino acids substitutions described herein with regard to Class 1 glucagon related peptides which enhance potency at the glucagon receptor. Such modifications reduce cleavage of the peptide bond between Asp15-Ser16.

In some embodiments, any of the Class 1 glucagon related peptides described herein can be further modified to reduce degradation at various amino acid positions by modifying any one, two, three, or all four of positions 20, 21, 24, or 27. Exemplary embodiments include substitution of Gln at position 20 with Ser, Thr, Ala or Aib, substitution of Asp at position 21 with Glu, substitution of Gln at position 24 with Ala or Aib, substitution of Met at position 27 with Leu or Nle. Removal or substitution of methionine reduces degradation due to oxidation of the methionine. Removal or substitution of Gln or Asn reduces degradation due to deamidation of Gln or Asn. Removal or substitution of Asp reduces degradation that occurs through dehydration of Asp to form a cyclic succinimide intermediate followed by isomerization to iso-aspartate.

Enhanced Potency

In accordance with another embodiment, Class 1 glucagon related peptides are provided that have enhanced potency at the glucagon receptor, wherein the peptides comprise an amino acid modification at position 16 of native glucagon (SEQ ID NO: 801). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. Substitution of serine at position 16 with glutamic acid enhances glucagon activity at least 2-fold, 4-fold, 5-fold and up to 10-fold greater at the glucagon receptor. In some embodiments, the Class 1 glucagon related peptide retains selectivity for the glucagon receptor relative to the GLP-1 receptors, e.g., at least 5-fold, 10-fold, or 15-fold selectivity.

DPP-IV Resistance

In some embodiments, the Class 1 glucagon peptides disclosed herein are further modified at position 1 or 2 to reduce susceptibility to cleavage by dipeptidyl peptidase IV. More particularly, in some embodiments, position 1 and/or position 2 of the Class 1 glucagon related peptide is substituted with the DPP-IV resistant amino acid(s) described herein. In some embodiments, position 2 of the analog peptide is substituted with an amino isobutyric acid. In some embodiments, position 2 of the analog peptide is substituted with an amino acid selected from the group consisting of D-serine, D-alanine, glycine, N-methyl serine, and ε-amino butyric acid. In another embodiment, position 2 of the Class 1 glucagon related peptide is substituted with an amino acid selected from the group consisting of D-serine, glycine, and aminoisobutyric acid. In some embodiments, the amino acid at position 2 is not D-serine.

Reduction in glucagon activity upon modification of the amino acids at position 1 and/or position 2 of the glucagon peptide can be restored by stabilization of the alpha-helix structure in the C-terminal portion of the glucagon peptide (around amino acids 12-29). The alpha helix structure can be stabilized by, e.g., formation of a covalent or non-covalent intramolecular bridge (e.g., a lactam bridge between side chains of amino acids at positions "i" and "i+4", wherein i is an integer from 12 to 25), substitution and/or insertion of amino acids around positions 12-29 with an alpha helix-stabilizing amino acid (e.g., an α,α-disubstituted amino acid), as further described herein.

Modifications at Position 3

Glucagon receptor activity can be reduced by an amino acid modification at position 3 (according to the amino acid numbering of wild type glucagon), e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog as described herein. For example, glucagon agonists can comprise the amino acid sequence of SEQ ID NO: 863, SEQ ID NO: 869, SEQ ID NO: 870, SEQ ID NO: 871, SEQ ID NO: 872, SEQ ID NO: 873, and SEQ ID NO: 874.

Enhancing GLP-1 Activity with C-Terminal Amides and Esters

Enhanced activity at the GLP-1 receptor is provided by replacing the carboxylic acid of the C-terminal amino acid with a charge-neutral group, such as an amide or ester. Conversely, retaining the native carboxylic acid at the C-terminus of the peptide maintains the relatively greater selectivity of the Class 1 glucagon related peptide for the glucagon receptor vs. the GLP-1 receptor (e.g., greater than about 5, 6, 7, 8, 9, 10, 11, 12, 13, 14, 15, 16, 17, 18, 19, or 20-fold).

Further Modifications and Combinations

Additional modifications may be made to the Class 1 glucagon related peptide which may further increase solubility and/or stability and/or glucagon activity. The Class 1 glucagon related peptide may alternatively comprise other modifications that do not substantially affect solubility or stability, and that do not substantially decrease glucagon activity. In exemplary embodiments, the Class 1 glucagon related peptide may comprise a total of up to 11, or up to 12, or up to 13, or up to 14 amino acid modifications relative to the native glucagon sequence. For example, conservative or non-conservative substitutions, additions or deletions may be carried out at any of positions 2, 5, 7, 10, 11, 12, 13, 14, 17, 18, 19, 20, 21, 24, 27, 28 or 29.

Exemplary modifications of the Class 1 glucagon related peptide include but are not limited to:

(a) non-conservative substitutions, conservative substitutions, additions or deletions while retaining at least partial glucagon agonist activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;

(b) deletion of amino acids at positions 29 and/or 28, and optionally position 27, while retaining at least partial glucagon agonist activity;

(c) modification of the aspartic acid at position 15, for example, by substitution with glutamic acid, homoglutamic acid, cysteic acid or homocysteic acid, which may reduce degradation; or modification of the serine at position 16, for example, by substitution of threonine, Aib, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;

(d) addition of a hydrophilic moiety such as the water soluble polymer polyethylene glycol, as described herein, e.g. at position 16, 17, 20, 21, 24, 29, 40 or at the C-terminal amino acid, which may increase solubility and/or half-life;

(e) modification of the methionine at position 27, for example, by substitution with leucine or norleucine, to reduce oxidative degradation;

(f) modification of the Gln at position 20 or 24, e.g. by substitution with Ser, Thr, Ala or Aib, to reduce degradation that occurs through deamidation of Gln (g) modification of Asp at position 21, e.g. by substitution with Glu, to reduce degradation that occurs through dehydration of Asp to form a cyclic succinimide intermediate followed by isomerization to iso-aspartate;

(h) modifications at position 1 or 2 as described herein that improve resistance to DPP-IV cleavage, optionally in combination with an intramolecular bridge such as a lactam bridge between positions "i" and "i+4", wherein i is an integer from 12 to 25, e.g., 12, 16, 20, 24;

(i) acylating or alkylating the glucagon peptide as described herein, which may increase the activity at the glucagon receptor and/or the GLP-1 receptor, increase half-life in circulation and/or extending the duration of action and/or delaying the onset of action, optionally combined with addition of a hydrophilic moiety, additionally or alternatively, optionally combined with a modification which selectively reduces activity at the GLP-1 peptide, e.g., a modification of the Thr at position 7, such as a substitution of the Thr at position 7 with an amino acid lacking a hydroxyl group, e.g., Abu or Ile; deleting amino acids C-terminal to the amino acid at position 27 (e.g., deleting one or both of the amino acids at positions 28 and 29, yielding a peptide 27 or 28 amino acids in length);

(j) C-terminal extensions as described herein;

(k) homodimerization or heterodimerization as described herein; and combinations of the (a) through (k).

In some embodiments, exemplary modifications of the Class 1 glucagon related peptide include at least one amino acid modification selected from Group A and one or more amino acid modifications selected from Group B and/or Group C, wherein Group A is:
   substitution of Asn at position 28 with a charged amino acid;
   substitution of Asn at position 28 with a charged amino acid selected from the group consisting of Lys, Arg, His, Asp, Glu, cysteic acid, and homocysteic acid;
   substitution at position 28 with Asn, Asp, or Glu;
   substitution at position 28 with Asp;
   substitution at position 28 with Glu;
   substitution of Thr at position 29 with a charged amino acid;
   substitution of Thr at position 29 with a charged amino acid selected from the group consisting of Lys, Arg, His, Asp, Glu, cysteic acid, and homocysteic acid;
   substitution at position 29 with Asp, Glu, or Lys;
   substitution at position 29 with Glu;
   insertion of 1-3 charged amino acids after position 29;
   insertion after position 29 of Glu or Lys;
   insertion after position 29 of Gly-Lys or Lys-Lys;
   or combinations thereof;

wherein Group B is:
   substitution of Asp at position 15 with Glu;
   substitution of Ser at position 16 with Thr or Aib;

and wherein Group C is:
   substitution of His at position 1 with a non-native amino acid that reduces susceptibility of the glucagon peptide to cleavage by dipeptidyl peptidase IV (DPP-IV), substitution of Ser at position 2 with a non-native amino acid that reduces susceptibility of the glucagon peptide to cleavage by dipeptidyl peptidase IV (DPP-IV), substitution of Lys at position 12 with Arg;
   substitution of Gln at position 20 with Ser, Thr, Ala or Aib;
   substitution of Asp at position 21 with Glu;
   substitution of Gln at position 24 with Ser, Thr, Ala or Aib;
   substitution of Met at position 27 with Leu or Nle;
   deletion of amino acids at positions 27-29;
   deletion of amino acids at positions 28-29;
   deletion of the amino acid at positions 29;
   or combinations thereof.

In exemplary embodiments, Lys at position 12 is substituted with Arg. In other exemplary embodiments amino acids at positions 29 and/or 28, and optionally at position 27, are deleted.

In some specific embodiments, the glucagon peptide comprises (a) an amino acid modification at position 1 and/or 2 that confers DPP-IV resistance, e.g., substitution with DMIA at position 1, or Aib at position 2, (b) an intramolecular bridge within positions 12-29, e.g. at positions 16 and 20, or one or more substitutions of the amino acids at positions 16, 20, 21, and 24 with an α,α disubstituted amino acid, optionally (c) linked to a hydrophilic moiety such as PEG, e.g., through Cys at position 24, 29 or at the C-terminal amino acid, optionally (d) an amino acid modification at position 27 that substitutes Met with, e.g., Nle, optionally (e) amino acid modifications at positions 20, 21 and 24 that reduce degradation, and optionally (f) linked to SEQ ID NO: 820. When the glucagon peptide is linked to SEQ ID NO: 820, the amino acid at position 29 in certain embodiments is Thr or Gly. In other specific embodiments, the glucagon peptide comprises (a) Asp28Glu29, or Glu28Glu29, or Glu29Glu30, or Glu28Glu30 or Asp28Glu30, and optionally (b) an amino acid modification at position 16 that substitutes Ser with, e.g. Thr or Aib, and optionally (c) an amino acid modification at position 27 that substitutes Met with, e.g., Nle, and optionally (d) amino acid modifications at positions 20, 21 and 24 that reduce degradation. In a specific embodiment, the glucagon peptide is T16, A20, E21, A24, Nle27, D28, E29.

In some embodiments, the Class 1 glucagon related peptide comprises the amino acid sequence:
   X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839) with 1 to 3 amino acid modifications thereto, wherein X1 and/or X2 is a non-native amino acid that reduces susceptibility of (or increases resistance of) the glucagon peptide to cleavage by dipeptidyl peptidase IV (DPP-IV), wherein Z is selected from the group consisting of —COOH (the naturally occurring C-terminal carboxylate), -Asn-COOH, Asn-Thr-COOH, and Y—COOH, wherein Y is 1 to 2 amino acids, and wherein an intramolecular bridge, preferably a covalent bond, connects the side chains of an amino acid at position i and an amino acid at position i+4, wherein i is 12, 16, 20 or 24.

In some embodiments, the intramolecular bridge is a lactam bridge. In some embodiments, the amino acids at positions i and i+4 of SEQ ID NO: 839 are Lys and Glu, e.g., Glu16 and Lys20. In some embodiments, X1 is selected from the group consisting of: D-His, N-methyl-His, alpha-methyl-His, imidazole acetic acid, des-amino-His, hydroxyl-His, acetyl-His, homo-His, and alpha, alpha-dimethyl imidiazole acetic acid (DMIA). In other embodiments, X2 is selected from the group consisting of: D-Ser, D-Ala, Gly, N-methyl-Ser, Val, and alpha, amino isobutyric acid (Aib). In some embodiments, the glucagon peptide is covalently linked to a hydrophilic moiety at any of amino acid positions 16, 17, 20, 21, 24, 29, 40, within a C-terminal extension, or at the C-terminal amino acid. In exemplary embodiments, this hydrophilic moiety is covalently linked to a Lys, Cys, Orn, homocysteine, or acetyl-phenylalanine residue at any of these positions. Exemplary hydrophilic moieties include polyethylene glycol (PEG), for example, of a molecular weight of about 1,000 Daltons to about 40,000 Daltons, or about 20,000 Daltons to about 40,000 Daltons.

In other embodiments, the Class I glucagon related peptide comprises the amino acid sequence:

```
                                        (SEQ ID NO: 839)
X1-X2-Gln-Gly-Thr-Phe-Thr-Ser-Asp-Tyr-Ser-Lys-

Tyr-Leu-Asp-Ser-Arg-Arg-Ala-Gln-Asp-Phe-Val-Gln-

Trp-Leu-Met-Z,
``` wherein X1 and/or X2 is a non-native amino acid that reduces susceptibility of (or increases resistance of) the glucagon peptide to cleavage by dipeptidyl peptidase IV (DPP-IV), wherein one, two, three, four or more of positions 16, 20, 21, and 24 of the glucagon peptide is substituted with an α,α-disubstituted amino acid, and wherein Z is selected from the group consisting of —COOH (the naturally occurring C-terminal carboxylate), -Asn-COOH, Asn-Thr-COOH, and Y—COOH, wherein Y is 1 to 2 amino acids.

Exemplary further amino acid modifications to the foregoing Class 1 glucagon related peptides or analogs include substitution of Thr at position 7 with an amino acid lacking a hydroxyl group, e.g., aminobutyric acid (Abu), Ile, optionally, in combination with substitution or addition of an amino acid comprising a side chain covalently attached (optionally, through a spacer) to an acyl or alkyl group, which acyl or alkyl group is non-native to a naturally-occurring amino acid, substitution of Lys at position 12 with Arg; substitution of Asp at position 15 with Glu; substitution of Ser at position 16 with Thr or Aib; substitution of Gln at position 20 with Ser, Thr, Ala or Aib; substitution of Asp at position 21 with Glu; substitution of Gln at position 24 with Ser, Thr, Ala or Aib; substitution of Met at position 27 with Leu or Nle; substitution of Asn at position 28 with a charged amino acid; substitution of Asn at position 28 with a charged amino acid selected from the group consisting of Lys, Arg, His, Asp, Glu, cysteic acid, and homocysteic acid; substitution at position 28 with Asn, Asp, or Glu; substitution at position 28 with Asp; substitution at position 28 with Glu; substitution of Thr at position 29 with a charged amino acid; substitution of Thr at position 29 with a charged amino acid selected from the group consisting of Lys, Arg, His, Asp, Glu, cysteic acid, and homocysteic acid; substitution at position 29 with Asp, Glu, or Lys; substitution at position 29 with Glu; insertion of 1-3 charged amino acids after position 29; insertion at position 30 (i.e., after position 29) of Glu or Lys; optionally with insertion at position 31 of Lys; addition of SEQ ID NO: 820 to the C-terminus, optionally, wherein the amino acid at position 29 is Thr or Gly; substitution or addition of an amino acid covalently attached to a hydrophilic moiety; or a combination thereof.

Any of the modifications described above in reference to Class 1 glucagon agonists which increase glucagon receptor activity, retain partial glucagon receptor activity, improve solubility, increase stability, or reduce degradation can be applied to Class 1 glucagon peptides individually or in combination. Thus, Class 1 glucagon related peptides can be prepared that retain at least 20% of the activity of native glucagon at the glucagon receptor, and which are soluble at a concentration of at least 1 mg/mL at a pH between 6 and 8 or between 6 and 9, (e.g. pH 7), and optionally retain at least 95% of the original peptide (e.g. 5% or less of the original peptide is degraded or cleaved) after 24 hours at 25° C. Alternatively, high potency Class 1 glucagon peptides can be prepared that exhibit at least about 100%, 125%, 150%, 175%, 200%, 250%, 300%, 350%, 400%, 450%, 500%, 600%, 700%, 800%, 900% or 10-fold or more of the activity of native glucagon at the glucagon receptor, and optionally are soluble at a concentration of at least 1 mg/mL at a pH between 6 and 8 or between 6 and 9, (e.g. pH 7), and optionally retains at least 95% of the original peptide (e.g. 5% or less of the original peptide is degraded or cleaved) after 24 hours at 25° C. In some embodiments, the Class 1 glucagon peptides described herein may exhibit at least any of the above indicated relative levels of activity at the glucagon receptor but no more than 1,000%, 5,000% or 10,000% of the activity of native glucagon at the glucagon receptor.

Examples of Embodiments of Class 1 Glucagon Related Peptides

In accordance with some embodiments the native glucagon peptide of SEQ ID NO: 801 is modified by the substitution of the native amino acid at position 28 and/or 29 with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the native glucagon peptide of SEQ ID NO: 801 is modified by the substitution of the native amino acid at position 29 with a positively charged amino acid (e.g., lysine, arginine or histidine) and optionally the addition of one or two positively charged amino acid (e.g., lysine, arginine or histidine) on the carboxy terminus of the peptide. In accordance with some embodiments a glucagon analog having improved solubility and stability is provided wherein the analog comprises the amino acid sequence of SEQ ID NO: 834 with the proviso that at least one amino acids at position, 28, or 29 is substituted with an acidic amino acid and/or an additional acidic amino acid is added at the carboxy terminus of SEQ ID NO: 834. In some embodiments the acidic amino acids are independently selected from the group consisting of Asp, Glu, cysteic acid and homocysteic acid.

In accordance with some embodiments a glucagon agonist having improved solubility and stability is provided wherein the agonist comprises the amino acid sequence of SEQ ID NO: 833, wherein at least one of the amino acids at positions 27, 28 or 29 is substituted with a non-native amino acid residue (i.e. at least one amino acid present at position 27, 28 or 29 of the analog is an acid amino acid different from the amino acid present at the corresponding position in SEQ ID NO: 801). In accordance with some embodiments a glucagon agonist is provided comprising the sequence of SEQ ID NO: 833 with the proviso that when the amino acid at position 28 is asparagine and the amino acid at position 29 is threonine, the peptide further comprises one to two amino acids, independently selected from the group consisting of Lys, Arg, His, Asp or Glu, added to the carboxy terminus of the glucagon peptide.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 16, 17, 18, 19, 20, 21, 24, 27, 28 or 29 of the peptide of SEQ ID NO: 811 can be substituted with an amino acid different from that present in the native glucagon peptide, and still retain the enhanced potency, physiological pH stability and biological activity of the parent glucagon peptide. For example, in accordance with some embodiments the methionine residue present at position 27 of the native peptide is changed to leucine or norleucine to prevent oxidative degradation of the peptide.

In some embodiments a glucagon analog of SEQ ID NO: 833 is provided wherein 1 to 6 amino acids, selected from positions 1, 2, 5, 7, 10, 11, 12, 13, 14, 16, 17, 18, 19, 20, 21 or 24 of the analog differ from the corresponding amino acid of SEQ ID NO: 801. In accordance with another embodiment a glucagon analog of SEQ ID NO: 833 is provided wherein 1 to 3 amino acids selected from positions 1, 2, 5, 7, 10, 11, 12, 13, 14, 16, 17, 18, 19, 20, 21 or 24 of the analog differ from the corresponding amino acid of SEQ ID NO: 801. In another embodiment, a glucagon analog of SEQ ID NO: 807, SEQ ID NO: 808 or SEQ ID NO: 834 is provided wherein 1 to 2 amino acids selected from positions 1, 2, 5, 7, 10, 11, 12, 13, 14, 16, 17, 18, 19, 20, 21 or 24 of the analog differ from the corresponding amino acid of SEQ ID NO: 801, and in a further embodiment those one to two differing amino acids represent conservative amino acid substitutions relative to the amino acid present in the native sequence (SEQ ID NO: 801). In some embodiments a glucagon peptide of SEQ ID NO: 811 or SEQ ID NO: 813 is provided wherein the glucagon peptide further comprises one, two or three amino acid substitutions at positions selected from positions 2, 5, 7, 10, 11, 12, 13, 14, 16, 17, 18, 19, 20, 21, 24, 27 or 29. In some embodiments the substitutions at positions 2, 5, 7, 10, 11, 12, 13, 14, 16, 17, 18, 19, 20, 27 or 29 are conservative amino acid substitutions.

In some embodiments a glucagon agonist is provided comprising an analog peptide of SEQ ID NO: 801 wherein the analog differs from SEQ ID NO: 801 by having an amino acid other than serine at position 2 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 2. More particularly, position 2 of the analog peptide is substituted with an amino acid selected from the group consisting of D-serine, alanine, D-alanine, glycine, n-methyl serine and amino isobutyric acid.

In another embodiment a glucagon agonist is provided comprising an analog peptide of SEQ ID NO: 801 wherein the analog differs from SEQ ID NO: 801 by having an amino acid other than histidine at position 1 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 1. More particularly, position 1 of the analog peptide is substituted with an amino acid selected from the group consisting of DMIA, D-histidine, desamino-histidine, hydroxyl-histidine, acetyl-histidine and homo-histidine.

In accordance with some embodiments the modified glucagon peptide comprises a sequence selected from the group consisting of SEQ ID NO: 809, SEQ ID NO: 812, SEQ ID NO: 813 and SEQ ID NO: 832. In a further embodiment a glucagon peptide is provided comprising a sequence of SEQ ID NO: 809, SEQ ID NO: 812, SEQ ID NO: 813 or SEQ ID NO: 832 further comprising one to two amino acids, added to the C-terminus of SEQ ID NO: 809, SEQ ID NO: 812, SEQ ID NO: 813 or SEQ ID NO: 832, wherein the additional amino acids are independently selected from the group consisting of Lys, Arg, His, Asp Glu, cysteic acid or homocysteic acid. In some embodiments the additional amino acids added to the carboxy terminus are selected from the group consisting of Lys, Arg, His, Asp or Glu or in a further embodiment the additional amino acids are Asp or Glu.

In another embodiment the glucagon peptide comprises the sequence of SEQ ID NO: 807 or a glucagon agonist analog thereof. In some embodiments the peptide comprising a sequence selected from the group consisting of SEQ ID NO: 808, SEQ ID NO: 810, SEQ ID NO: 811, SEQ ID NO: 812 and SEQ ID NO: 813. In another embodiment the peptide comprising a sequence selected from the group consisting of SEQ ID NO: 808, SEQ ID NO: 810 and SEQ ID NO: 811. In some embodiments the glucagon peptide comprises the sequence of SEQ ID NO: 808, SEQ ID NO: 810 and SEQ ID NO: 811 further comprising an additional amino acid, selected from the group consisting of Asp and Glu, added to the C-terminus of the glucagon peptide. In some embodiments the glucagon peptide comprises the sequence of SEQ ID NO: 811 or SEQ ID NO: 813, and in a further embodiment the glucagon peptide comprises the sequence of SEQ ID NO: 811.

In accordance with some embodiments a glucagon agonist is provided comprising a modified glucagon peptide selected from the group consisting of:

(SEQ ID NO: 834)
NH$_2$-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R, (SEQ ID NO: 811)
NH$_2$-His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asp-Thr-R
and (SEQ ID NO: 813)
NH$_2$-His-Ser-Gln-Gly-Thr-Phe-Thr-Ser-Asp-Tyr-Ser-Xaa-Tyr-Leu-Glu-Ser-Arg-Arg-Ala-Gln-Asp-Phe-Val-Gln-Trp-Leu-Met-Asp-Thr-R wherein Xaa at position 15 is Asp, Glu, cysteic acid, homoglutamic acid or homocysteic acid, the Xaa at position 28 is Asn or an acidic amino acid and the Xaa at position 29 is Thr or an acidic amino acid and R is an acidic amino acid, COOH or CONH$_2$, with the proviso that an acidic acid residue is present at one of positions 28, 29 or 30. In some embodiments R is COOH, and in another embodiment R is CONH$_2$.

The present disclosure also encompasses glucagon fusion peptides wherein a second peptide has been fused to the C-terminus of the glucagon peptide to enhance the stability and solubility of the glucagon peptide. More particularly, the fusion glucagon peptide may comprise a glucagon agonist analog comprising a glucagon peptide NH$_2$—His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R (SEQ ID NO: 834), wherein R is an acidic amino acid or a bond and an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon peptide. In some embodiments the glucagon peptide is selected from the group consisting of SEQ ID NO: 833, SEQ ID NO: 807 or SEQ ID NO: 808 further comprising an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon peptide. In some embodiments the glucagon fusion peptide comprises SEQ ID NO: 802, SEQ ID NO: 803, SEQ ID NO: 804, SEQ ID NO: 805 and SEQ ID NO: 806 or a glucagon agonist analog thereof, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon peptide. In accordance with some embodiments the fusion peptide further comprises a PEG chain linked to an amino acid at position 16, 17, 21, 24, 29, within a C-terminal extension, or at the C-terminal amino acid, wherein the PEG chain is selected from the range of 500 to 40,000 Daltons. In some embodiments the amino acid sequence of SEQ ID NO: 820 (GPSSGAPPPS), SEQ ID NO: 821 (KRNRNNIA) or SEQ ID NO: 822 (KRNR) is bound to amino acid 29 of the glucagon peptide through a peptide bond. In some embodiments the glucagon peptide portion of the glucagon fusion peptide comprises a sequence selected from the group consisting of SEQ ID NO: 810, SEQ ID NO: 811 and SEQ ID NO: 813. In some embodiments the glucagon peptide portion of the glucagon fusion peptide comprises the sequence of SEQ ID NO: 811 or SEQ ID NO: 813, wherein a PEG chain is linked at position 21, 24, 29, within a C-terminal extension or at the C-terminal amino acid, respectively.

In another embodiment the glucagon peptide sequence of the fusion peptide comprises the sequence of SEQ ID NO: 811, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon peptide. In some embodiments the glucagon fusion peptide comprises a sequence selected from the group consisting of SEQ ID NO: 824, SEQ ID NO: 825 and SEQ ID NO: 826. Typically the fusion peptides of the present invention will have a C-terminal amino acid with the standard carboxylic acid group. However, analogs of those sequences wherein the C-terminal amino acid has an amide substituted for the carboxylic acid are also encompassed as embodiments. In accordance with some embodiments the fusion glucagon peptide comprises a glucagon agonist analog selected from the group consisting of SEQ ID NO: 810, SEQ ID NO: 811 and SEQ ID NO: 813, further comprising an amino acid sequence of SEQ ID NO: 823 (GPSSGAPPPS-CONH$_2$) linked to amino acid 29 of the glucagon peptide.

The glucagon agonists of the present invention can be further modified to improve the peptide's solubility and stability in aqueous solutions while retaining the biological activity of the glucagon peptide. In accordance with some embodiments, introduction of hydrophilic groups at one or more positions selected from positions 16, 17, 20, 21, 24 and 29 of the peptide of SEQ ID NO: 811, or a glucagon agonist analog thereof, are anticipated to improve the solubility and stability of the pH stabilize glucagon analog. More particularly, in some embodiments the glucagon peptide of SEQ ID NO: 810, SEQ ID NO: 811, SEQ ID NO: 813, or SEQ ID NO: 832 is modified to comprise one or more hydrophilic groups covalently linked to the side chains of amino acids present at positions 21 and 24 of the glucagon peptide.

In accordance with some embodiments, the glucagon peptide of SEQ ID NO: 811 is modified to contain one or more amino acid substitution at positions 16, 17, 20, 21, 24 and/or 29, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein.

In some embodiments, a glucagon agonist of SEQ ID NO: 810, SEQ ID NO: 811 or SEQ ID NO: 813 is provided wherein the native glucagon peptide sequence has been modified to contain a naturally occurring or synthetic amino acid in at least one of positions 16, 17, 21, 24, 29, within a C-terminal extension or at the C-terminal amino acid of the native sequence, wherein the amino acid substitute further comprises a hydrophilic moiety. In some embodiments the substitution is at position 21 or 24, and in a further embodiment the hydrophilic moiety is a PEG chain. In some embodiments the glucagon peptide of SEQ ID NO: 811 is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, the native glucagon peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In some embodiments the glucagon peptide is selected form the group consisting of SEQ ID NO: 814, SEQ ID NO: 815, SEQ ID NO: 816, SEQ ID NO: 817, SEQ ID NO: 818 and SEQ ID NO: 819.

In accordance with some embodiments the pegylated glucagon peptide comprises two or more polyethylene glycol chains covalently bound to the glucagon peptide wherein the total molecular weight of the glucagon chains is about 1,000 to about 5,000 Daltons. In some embodiments the pegylated glucagon agonist comprises a peptide of SEQ ID NO: 806, wherein a PEG chain is covalently linked to the amino acid residue at position 21 and at position 24, and wherein the combined molecular weight of the two PEG chains is about 1,000 to about 5,000 Daltons. In another embodiment the pegylated glucagon agonist comprises a peptide of SEQ ID NO: 806, wherein a PEG chain is covalently linked to the amino acid residue at position 21 and at position 24, and wherein the combined molecular weight of the two PEG chains is about 5,000 to about 20,000 Daltons.

The polyethylene glycol chain may be in the form of a straight chain or it may be branched. In accordance with some embodiments the polyethylene glycol chain has an average molecular weight selected from the range of about 500 to about 40,000 Daltons. In some embodiments the polyethylene glycol chain has a molecular weight selected from the range of about 500 to about 5,000 Daltons. In another embodiment the polyethylene glycol chain has a molecular weight of about 20,000 to about 40,000 Daltons.

Any of the glucagon peptides described above may be further modified to include a covalent or non-covalent intramolecular bridge or an alpha helix-stabilizing amino acid within the C-terminal portion of the glucagon peptide (amino acid positions 12-29). In accordance with some embodiments, the glucagon peptide comprises any one or more of the modifications discussed above in addition to an amino acid substitution at positions 16, 20, 21, or 24 (or a combination thereof) with an α,α-disubstituted amino acid, e.g., Aib. In accordance with another embodiment, the glucagon peptide comprises any one or more modifications discussed above in addition to an intramolecular bridge, e.g., a lactam, between the side chains of the amino acids at positions 16 and 20 of the glucagon peptide.

In accordance with some embodiments, the glucagon peptide comprises the amino acid sequence of SEQ ID NO: 877, wherein the Xaa at position 3 is an amino acid comprising a side chain of Structure I, II, or III:

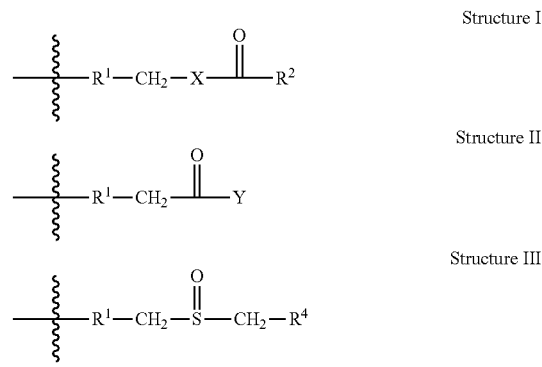

wherein $R^1$ is $C_{0-3}$ alkyl or $C_{0-3}$ heteroalkyl; $R^2$ is $NHR^4$ or $C_{1-3}$ alkyl; $R^3$ is $C_{1-3}$ alkyl; $R^4$ is H or $C_{1-3}$ alkyl; X is NH, O, or S; and Y is $NHR^4$, $SR^3$, or $OR^3$. In some embodiments, X is NH or Y is NHR$^4$. In some embodiments, R$^1$ is C$_{0-2}$ alkyl or C$_1$ heteroalkyl. In some embodiments, R$^2$ is NHR$^4$ or C$_1$ alkyl. In some embodiments, R$^4$ is H or C$^1$ alkyl. In exemplary embodiments an amino acid comprising a side chain of Structure I is provided wherein, R$^1$ is CH$_2$—S, X is NH, and R$^2$ is CH$_3$ (acetamidomethyl-cysteine, C(Acm)); R$^1$ is CH$_2$, X is NH, and R$^2$ is CH$_3$ (acetyldiaminobutanoic acid, Dab(Ac)); R$^1$ is C$_0$ alkyl, X is NH, R$^2$ is NHR$^4$, and R$^4$ is H (carbamoyl-diaminopropanoic acid, Dap(urea)); or R$^1$ is CH$_2$—CH$_2$, X is NH, and R$^2$ is CH$_3$ (acetylornithine, Orn(Ac)). In exemplary embodiments an amino acid comprising a side chain of Structure II is provided, wherein R$^1$ is CH$_2$, Y is NHR$^4$, and R$^4$ is CH$_3$ (methylglutamine, Q(Me)); In exemplary embodiments an amino acid comprising a side chain of Structure III is provided wherein, R$^1$ is CH$_2$ and R$^4$ is H (methionine-sulfoxide, M(O)); In specific embodiments, the amino acid at position 3 is substituted with Dab(Ac). For example, glucagon agonists can comprise the amino acid sequence of SEQ ID NO: 863, SEQ ID NO: 869, SEQ ID NO: 871, SEQ ID NO: 872, SEQ ID NO: 873, and SEQ ID NO: 874.

In certain embodiments, the glucagon peptide is an analog of the glucagon peptide of SEQ ID NO: 877. In specific aspects, the analog comprises any of the amino acid modifications described herein, including, but not limited to: a substitution of Asn at position 28 with a charged amino acid; a substitution of Asn at position 28 with a charged amino acid selected from the group consisting of Lys, Arg, His, Asp, Glu, cysteic acid, and homocysteic acid; a substitution at position 28 with Asn, Asp, or Glu; a substitution at position 28 with Asp; a substitution at position 28 with Glu; a substitution of Thr at position 29 with a charged amino acid; a substitution of Thr at position 29 with a charged amino acid selected from the group consisting of Lys, Arg, His, Asp, Glu, cysteic acid, and homocysteic acid; a substitution at position 29 with Asp, Glu, or Lys; a substitution at position 29 with Glu; a insertion of 1-3 charged amino acids after position 29; an insertion after position 29 of Glu or Lys; an insertion after position 29 of Gly-Lys or Lys-Lys; and a combination thereof.

In certain embodiments, the analog of the glucagon peptide of SEQ ID NO: 877 comprises an α,α-disubstituted amino acid, such as Aib, at one, two, three, or all of positions 16, 20, 21, and 24.

In certain embodiments, the analog of the glucagon peptide of SEQ ID NO: 877 comprises one or more of the following: substitution of His at position 1 with a non-native amino acid that reduces susceptibility of the glucagon peptide to cleavage by dipeptidyl peptidase IV (DPP-IV), substitution of Ser at position 2 with a non-native amino acid that reduces susceptibility of the glucagon peptide to cleavage by dipeptidyl peptidase IV (DPP-IV), substitution of Thr at position 7 with an amino acid lacking a hydroxyl group, e.g., Abu or Ile; substitution of Tyr at position 10 with Phe or Val; substitution of Lys at position 12 with Arg; substitution of Asp at position 15 with Glu, substitution of Ser at position 16 with Thr or Aib; substitution of Gln at position 20 with Ala or Aib; substitution of Asp at position 21 with Glu; substitution of Gln at position 24 with Ala or Aib; substitution of Met at position 27 with Leu or Nle; deletion of amino acids at positions 27-29; deletion of amino acids at positions 28-29; deletion of the amino acid at positions 29; addition of the amino acid sequence of SEQ ID NO: 820 to the C-terminus, wherein the amino acid at position 29 is Thr or Gly, or a combination thereof.

In accordance with specific embodiments, the glucagon peptide comprises the amino acid sequence of any of SEQ ID NOs: 862-867 and 869-874.

In certain embodiments, the analog of the glucagon peptide comprising SEQ ID NO: 877 comprises a hydrophilic moiety, e.g., PEG, covalently linked to the amino acid at any of positions 16, 17, 20, 21, 24, and 29 or at the C-terminal amino acid.

In certain embodiments, the analog of the glucagon peptide comprising SEQ ID NO: 877 comprises an amino acid comprising a side chain covalently attached, optionally, through a spacer, to an acyl group or an alkyl group, which acyl group or alkyl group is non-native to a naturally-occurring amino acid. The acyl group in some embodiments is a C4 to C30 fatty acyl group. In other embodiments, the alkyl group is a C4 to C30 alkyl. In specific aspects, the acyl group or alkyl group is covalently attached to the side chain of the amino acid at position 10. In some embodiments, the amino acid at position 7 is Ile or Abu.

The glucagon agonist may be a peptide comprising the amino acid sequence of any of the SEQ ID NOs: 801-919, optionally with up to 1, 2, 3, 4, or 5 further modifications that retain glucagon agonist activity. In certain embodiments, the glucagon agonist comprises the amino acids of any of SEQ ID NOs: 859-919.

Class 2 Glucagon Related Peptides

In certain embodiments, the glucagon related peptide is a Class 2 glucagon related peptide, which is described herein and in International Patent Publication No. WO 2010/011439, and U.S. Application No. 61/187,578, (filed on Jun. 16, 2009) the contents of which are incorporated by reference in their entirety.

The biological sequences referenced in the following section (SEQ ID NOs: 1001-1262) relating to Class 2 glucagon related peptides correspond to SEQ ID NOs: 1-262 in International Patent Publication No. WO 2010/011439. SEQ ID NOs: 1263 to 1275 relating to Class 2 glucagon related peptides correspond to SEQ ID NOs: 657 to 669 in U.S. Application No. 61/187,578.

Activity

Native glucagon does not activate the GIP receptor, and normally has about 1% of the activity of native-GLP-1 at the GLP-1 receptor. Modifications to the native glucagon sequence described herein produce Class 2 glucagon related peptides that can exhibit potent glucagon activity equivalent to or better than the activity of native glucagon (SEQ ID NO: 1001), potent GIP activity equivalent to or better than the activity of native GIP (SEQ ID NO: 1004), and/or potent GLP-1 activity equivalent to or better than the activity of native GLP-1. In this regard, the Class 2 glucagon related peptide may be one of a glucagon/GIP co-agonist, glucagon/GIP/GLP-1 tri-agonist, GIP/GLP-1 co-agonist, or a GIP agonist glucagon peptide, as further described herein.

In some embodiments, the Class 2 glucagon related peptides described herein exhibit an EC$_{50}$ for GIP receptor activation activity of about 100 nM or less, or about 75, 50, 25, 10, 8, 6, 5, 4, 3, 2 or 1 nM or less. In some embodiments, the Class 2 glucagon related peptides exhibit an EC$_{50}$ for glucagon receptor activation of about 100 nM or less, or about 75, 50, 25, 10, 8, 6, 5, 4, 3, 2 or 1 nM or less. In some embodiments, the Class 2 glucagon related peptides exhibit an EC$_{50}$ for GLP-1 receptor activation of about 100 nM or less, or about 75, 50, 25, 10, 8, 6, 5, 4, 3, 2 or 1 nM or less. Receptor activation can be measured by in vitro assays measuring cAMP induction in HEK293 cells over-expressing the receptor, e.g. assaying HEK293 cells co-transfected with DNA encoding the receptor and a luciferase gene linked to cAMP responsive element as described in Example 2.

In some embodiments, Class 2 glucagon related peptides exhibit at least about 0.1%, 0.2%, 0.3%, 0.4%, 0.5%, 0.6%, 0.7%, 0.8%, 0.9%, 1%, 5%, 10%, 20%, 30%, 40%, 50%, 60%, 75%, 100%, 125%, 150%, 175% or 200% or higher activity at the GIP receptor relative to native GIP (GIP potency). In some embodiments, the glucagon peptides described herein exhibit no more than 1000%, 10,000%, 100,000%, or 1,000,000% activity at the GIP receptor relative to native GIP. In some embodiments, Class 2 glucagon related peptides exhibit at least about 1%, 5%, 10%, 20%, 30%, 40%, 50%, 60%, 75%, 100%, 125%, 150%, 175%, 200%, 250%, 300%, 350%, 400%, 450%, or 500% or higher activity at the glucagon receptor relative to native glucagon (glucagon potency). In some embodiments, the glucagon peptides described herein exhibit no more than 1000%, 10,000%, 100,000%, or 1,000,000% activity at the glucagon receptor relative to native glucagon. In some embodiments, Class 2 glucagon related peptides exhibit at least about 0.1%, 0.2%, 0.3%, 0.4%, 0.5%, 0.6%, 0.7%, 0.8%, 0.9%, 1%, 5%, 10%, 20%, 30%, 40%, 50%, 60%, 75%, 100%, 125%, 150%, 175% or 200% or higher activity at the GLP-1 receptor relative to native GLP-1 (GLP-1 potency). In some embodiments, the glucagon peptides described herein exhibit no more than 1000%, 10,000%, 100,000%, or 1,000,000% activity at the GLP-1 receptor relative to native GLP-1. A Class 2 glucagon related peptide's activity at a receptor relative to a native ligand of the receptor is calculated as the inverse ratio of $EC_{50}$s for the Class 2 glucagon related peptide vs. the native ligand.

In some embodiments, Class 2 glucagon related peptides exhibit activity at both the glucagon receptor and the GIP receptor ("glucagon/GIP co-agonists"). These Class 2 glucagon related peptides have lost native glucagon's selectivity for glucagon receptor compared to GIP receptor. In some embodiments, the $EC_{50}$ of the Class 2 glucagon related peptide at the GIP receptor is less than about 50-fold, 40-fold, 30-fold or 20-fold different (higher or lower) from its $EC_{50}$ at the glucagon receptor. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon potency. In some embodiments, the ratio of the $EC_{50}$ of the Class 2 glucagon related peptide at the GIP receptor divided by the $EC_{50}$ of the Class 2 glucagon related peptide at the glucagon receptor is less than about 100, 75, 60, 50, 40, 30, 20, 15, 10, or 5. In some embodiments, the ratio of the $EC_{50}$ at the GIP receptor divided by the $EC_{50}$ at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the GIP potency of the Class 2 glucagon related peptide compared to the glucagon potency of the Class 2 glucagon related peptide is less than about 500, 450, 400, 350, 300, 250, 200, 150, 100, 75, 60, 50, 40, 30, 20, 15, 10, or 5. In some embodiments, the ratio of the potency at the GIP receptor divided by the potency at the glucagon receptor is about 1 or less than about 1 (e.g., about 0.01, 0.013, 0.0167, 0.02, 0.025, 0.03, 0.05, 0.067, 0.1, 0.2). In some embodiments, GLP-1 activity have been significantly reduced or destroyed, e.g., by an amino acid modification at position 7, a deletion of the amino acid(s)C-terminal to the amino acid at position 27 or 28, yielding a 27- or 28-amino acid peptide, or a combination thereof.

In another aspect, Class 2 glucagon related peptides exhibit activity at the glucagon, GIP and GLP-1 receptors ("glucagon/GIP/GLP-1 tri-agonists"). These Class 2 glucagon related peptides have lost native glucagon's selectivity for the glucagon receptor compared to both the GLP-1 and GIP receptors. In some embodiments, the $EC_{50}$ of the Class 2 glucagon related peptide at the GIP receptor is less than about 50-fold, 40-fold, 30-fold or 20-fold different (higher or lower) from its respective $EC_{50}$s at the glucagon and GLP-1 receptors. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon and GLP-1 potencies. In some embodiments, the ratio of the $EC_{50}$ of the tri-agonist at the GIP receptor divided by the $EC_{50}$ of the tri-agonist at the GLP-1 receptor is less than about 100, 75, 60, 50, 40, 30, 20, 15, 10, or 5. In some embodiments, the ratio of the $EC_{50}$ at the GIP receptor divided by the $EC_{50}$ at the GLP-1 receptor is about 1 or less than about 1 (e.g., about 0.01, 0.013, 0.0167, 0.02, 0.025, 0.03, 0.05, 0.067, 0.1, 0.2). In some embodiments, the ratio of the GIP potency of the tri-agonist compared to the GLP-1 potency of the tri-agonist is less than about 100, 75, 60, 50, 40, 30, 20, 15, 10, or 5. In some embodiments, the ratio of the potency at the GIP receptor divided by the potency at the GLP-1 receptor is about 1 or less than about 1 (e.g., about 0.01, 0.013, 0.0167, 0.02, 0.025, 0.03, 0.05, 0.067, 0.1, 0.2). In related embodiments, the ratio of the $EC_{50}$ of the tri-agonist at the GIP receptor divided by the $EC_{50}$ of the tri-agonist at the glucagon receptor is less than about 100, 75, 60, 50, 40, 30, 20, 15, 10, or 5. In some embodiments, the ratio of the $EC_{50}$ at the GIP receptor divided by the $EC_{50}$ at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the GIP potency of the tri-agonist compared to the glucagon potency of the tri-agonist is less than about 500, 450, 400, 350, 300, 250, 200, 150, 100, 75, 60, 50, 40, 30, 20, 15, 10, or 5. In some embodiments, the ratio of the potency at the GIP receptor divided by the potency at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the $EC_{50}$ of the tri-agonist at the GLP-1 receptor divided by the $EC_{50}$ of the tri-agonist at the glucagon receptor is less than about 100, 75, 60, 50, 40, 30, 20, 15, 10, or 5. In some embodiments, the ratio of the $EC_{50}$ at the GLP-1 receptor divided by the $EC_{50}$ at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the GLP-1 potency of the tri-agonist compared to the glucagon potency of the tri-agonist is less than about 100, 75, 60, 50, 40, 30, 20, 15, 10, or 5. In some embodiments, the ratio of the potency at the GLP-1 receptor divided by the potency at the glucagon receptor is about 1 or less than about 1 (e.g., about 0.01, 0.013, 0.0167, 0.02, 0.025, 0.03, 0.05, 0.067, 0.1, 0.2).

In yet another aspect, Class 2 glucagon related peptides exhibit activity at the GLP-1 and GIP receptors, but in which the glucagon activity has been significantly reduced or destroyed ("GIP/GLP-1 co-agonists"), e.g., by an amino acid modification at position 3. For example, substitution at this position with an acidic, basic, or a hydrophobic amino acid (glutamic acid, ornithine, norleucine) reduces glucagon activity. In some embodiments, the $EC_{50}$ of the glucagon peptide at the GIP receptor is less than about 50-fold, 40-fold, 30-fold or 20-fold different (higher or lower) from its $EC_{50}$ at the GLP-1 receptor. In some embodiments, the GIP potency of the Class 2 glucagon related peptide is less than about 25-, 20-, 15-, 10-, or 5-fold different (higher or lower) from its GLP-1 potency. In some embodiments these Class 2 glucagon related peptides have about 10% or less of the activity of native glucagon at the glucagon receptor, e.g. about 1-10%, or about 0.1-10%, or greater than about 0.1% but less than about 10%. In some embodiments, the ratio of the $EC_{50}$ of the Class 2 glucagon related peptide at the GIP receptor divided by the $EC_{50}$ of the Class 2 glucagon related peptide at the GLP-1 receptor is less than about 100, 75, 60, 50, 40, 30, 20, 15, 10, or 5, and no less than 1. In some embodiments, the ratio of the GIP potency of the Class 2 glucagon related peptide compared to the GLP-1 potency of the Class 2 glucagon related peptide is less than about 100, 75, 60, 50, 40, 30, 20, 15, 10, or 5, and no less than 1.

In a further aspect, Class 2 glucagon related peptides exhibit activity at the GIP receptor, in which the glucagon and GLP-1 activity have been significantly reduced or destroyed ("GIP agonist glucagon peptides"), e.g., by amino acid modifications at positions 3 with Glu and 7 with Ile. In some embodiments, these Class 2 glucagon related peptides have about 10% or less of the activity of native glucagon at the glucagon receptor, e.g. about 1-10%, or about 0.1-10%, or greater than about 0.1%, 0.5%, or 1% but less than about 1%, 5%, or 10%. In some embodiments these Class 2 glucagon related peptides also have about 10% or less of the activity of native GLP-1 at the GLP-1 receptor, e.g. about 1-10%, or about 0.1-10%, or greater than about 0.1%, 0.5%, or 1% but less than about 1%, 5%, or 10%.

In some embodiments, when the Class 2 glucagon related peptide is not pegylated, the $EC_{50}$ of the Class 2 glucagon related peptide for GIP receptor activation is about 4, 2, 1 nM or less, or the analog has at least about 1%, 2%, 3%, 4% or 5% of the activity of native GIP at the GIP receptor. In related embodiments, the $EC_{50}$ of the unpegylated Class 2 glucagon related peptide for GLP-1 receptor activation is about 4, 2, 1 nM or less or has at least about 1%, 2%, 3%, 4% or 5% of the activity of native GLP-1 at the GLP-1 receptor. In yet other related embodiments, the $EC_{50}$ of the unpegylated Class 2 glucagon related peptide for glucagon receptor activation is about 4, 2, 1 nM or less, or at least about 5%, 10%, 15% or 20% of the activity of native glucagon at the glucagon receptor. In some embodiments, the unpegylated Class 2 glucagon related peptide has less than about 1% of the activity of native glucagon at the glucagon receptor. In other embodiments, the unpegylated Class 2 glucagon related peptide has less than about 10%, 5% or 1% of the activity of native GLP-1 at the GLP-1 receptor.

In embodiments where the Class 2 glucagon related peptides are linked to hydrophilic moieties such as PEG, the relative $EC_{50}$s at one or more receptors may be higher e.g., about 10-fold higher. For example, the $EC_{50}$ of a pegylated analog for GIP receptor activation is about 10 nM or less, or the Class 2 glucagon related peptide has at least about 0.1%, 0.2%, 0.3%, 0.4% or 0.5% of the activity of native GIP at the GIP receptor. In related embodiments, the $EC_{50}$ of a pegylated Class 2 glucagon related peptide for GLP-1 receptor activation is about 10 nM or less or has at least about 0.1%, 0.2%, 0.3%, 0.4% or 0.5% of the activity of native GLP-1 at the GLP-1 receptor. In yet other related embodiments, the $EC_{50}$ of a pegylated Class 2 glucagon related peptide for glucagon receptor activation is about 10 nM or less, or at least about 0.5%, 1%, 1.5% or 2% of the activity of native glucagon at the glucagon receptor. In some embodiments, the Class 2 glucagon related peptide has less than about 1% of the activity of native glucagon at the glucagon receptor. In other embodiments, the Class 2 glucagon related peptide has less than about 10%, 5% or 1% of the activity of native GLP-1 at the GLP-1 receptor.

Modifications

The modifications disclosed herein in reference to a Class 2 glucagon related peptide permit the manipulation of glucagon (SEQ ID NO: 1001) to create glucagon peptides that exhibit increased GIP activity, glucagon activity, and/or GLP-1 activity. Other modifications disclosed herein in reference to a Class 2 glucagon related peptide prolong the half-life, increase solubility, or increase stability of the resulting peptide. Yet other modifications disclosed herein in reference to a Class 2 glucagon related peptide have no effect on activity, or can be made without destroying the desired activity or activities. Any of the combinations in reference to a Class 2 glucagon related peptide that serve the same purpose (e.g. increasing GIP activity) can be applied individually or in combination. Any of the single or sets of combinations in reference to a Class 2 glucagon related peptide that confer enhanced properties can be applied individually or in combination, e.g. increased GIP and/or GLP-1 activity can be combined with increased half-life. In related embodiments, 1, 2, 3, 4, 5, 6 or more of the amino acid modifications may be non-conservative substitutions, additions or deletions. In some embodiments, 1, 2, 3, 4, 5, 6 or more of the amino acid modifications may be conservative substitutions.

Modifications that Affect GIP Activity

Enhanced activity at the GIP receptor is provided by an amino acid modification at position 1. For example, His at position 1 is substituted with a large, aromatic amino acid, optionally Tyr, Phe, Trp, amino-Phe, nitro-Phe, chloro-Phe, sulfo-Phe, 4-pyridyl-Ala, methyl-Tyr, or 3-amino Tyr. The combination of Tyr at position 1 with stabilization of the alpha helix within the region corresponding to amino acids 12-29 provided a Class 2 glucagon related peptide that activates the GIP receptor as well as the GLP-1 receptor and the glucagon receptor. The alpha helix structure can be stabilized by, e.g., formation of a covalent or non-covalent intramolecular bridge, or substitution and/or insertion of amino acids around positions 12-29 with an alpha helix-stabilizing amino acid (e.g., an $\alpha,\alpha$-disubstituted amino acid).

Enhanced activity at the GIP receptor is also provided by amino acid modifications at positions 27 and/or 28, and optionally at position 29. For example, the Met at position 27 is substituted with a large aliphatic amino acid, optionally Leu, the Asn at position 28 is substituted with a small aliphatic amino acid, optionally Ala, and the Thr at position 29 is substituted with a small aliphatic amino acid, optionally Gly. Substitution with LAG at positions 27-29 provides increased GIP activity relative to the native MNT sequence at those positions.

Enhanced activity at the GIP receptor is also provided by an amino acid modification at position 12. For example, position 12 is substituted with a large, aliphatic, nonpolar amino acid, optionally Ile.

Enhanced activity at the GIP receptor is also provided by an amino acid modification at positions 17 and/or 18. For example, position 17 is substituted with a polar residue, optionally Gln, and position 18 is substituted with a small aliphatic amino acid, optionally Ala. A substitution with QA at positions 17 and 18 provides increased GIP activity relative to the native RR sequence at those positions.

Increased activity at the GIP receptor is provided by modifications that permit formation of an intramolecular bridge between amino acid side chains at positions from 12 to 29. For example, an intramolecular bridge can be formed by a covalent bond between the side chains of two amino acids at positions i and i+4 or between positions j and j+3, or between positions k and k+7. In exemplary embodiments, the bridge is between positions 12 and 16, 16 and 20, 20 and 24, 24 and 28, or 17 and 20. In other embodiments, non-covalent interactions such as salt bridges can be formed between positively and negatively charged amino acids at these positions.

Any of the modifications described above which increase GIP receptor activity can be applied individually or in combination. Combinations of the modifications that increase GIP receptor activity generally provide higher GIP activity than any of such modifications taken alone.

Modifications that Affect Glucagon Activity

In some embodiments, enhanced glucagon potency is provided by an amino acid modification at position 16 of native glucagon (SEQ ID NO: 1001). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In some embodiments the glucagon peptide retains its original selectivity for the glucagon receptor relative to the GLP-1 receptors.

Glucagon receptor activity can be reduced by an amino acid modification at position 3, e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog, as described herein. For example, glucagon agonists can comprise the amino acid sequence of any of SEQ ID NOs: 1243-1248, 1250, 1251, and 1253-1256.

Restoration of glucagon activity which has been reduced by amino acid modifications at positions 1 and 2 is provided by modifications that that stabilize the alpha helix structure of the C-terminal portion (amino acids 12-29) of the glucagon peptide or analog thereof. For example, an intramolecular bridge can be formed by a covalent bond between the side chains of two amino acids at positions i and i+4 or between positions j and j+3, or between positions k and k+7. In other embodiments, non-covalent interactions such as salt bridges can be formed between positively and negatively charged amino acids at these positions. In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., Aib.

Modifications that Affect GLP-1 Activity

Enhanced activity at the GLP-1 receptor is provided by replacing the carboxylic acid of the C-terminal amino acid with a charge-neutral group, such as an amide or ester.

Enhanced activity at the GLP-1 receptor is also provided by stabilizing the alpha-helix structure in the C-terminal portion of glucagon (around amino acids 12-29), e.g., through formation of an intramolecular bridge between the side chains of two amino acids, or substitution and/or insertion of amino acids around positions 12-29 with an alpha helix-stabilizing amino acid (e.g., an α,α-disubstituted amino acid), as further described herein. In exemplary embodiments, the side chains of the amino acid pairs 12 and 16, 13 and 17, 16 and 20, 17 and 21, 20 and 24 or 24 and 28 (amino acid pairs in which i=12, 16, 20, or 24) are linked to one another and thus stabilize the glucagon alpha helix. In some embodiments, the bridge or linker is about 8 (or about 7-9) atoms in length, particularly when the bridge is between positions i and i+4. In some embodiments, the bridge or linker is about 6 (or about 5-7) atoms in length, particularly when the bridge is between positions j and j+3.

In some embodiments, intramolecular bridges are formed by (a) substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms, and (b) substituting the naturally occurring glutamine at position 20 with another hydrophilic amino acid having a side chain that is either charged or has an ability to hydrogen-bond, and is at least about 5 (or about 4-6) atoms in length, for example, lysine, citrulline, arginine, or ornithine. The side chains of such amino acids at positions 16 and 20 can form a salt bridge or can be covalently linked. In some embodiments the two amino acids are bound to one another to form a lactam ring.

In some embodiments, stabilization of the alpha helix structure in the C-terminal portion of the glucagon peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of a, co-diaminoalkane tethers, the formation of metal-atom bridges, and other means of peptide cyclization are used to stabilize the alpha helix.

In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., Aib.

Increased activity at the GLP-1 receptor is provided by an amino acid modification at position 20 as described herein.

Increased activity at the GLP-1 receptor is provided by adding GPSSGAPPPS (SEQ ID NO: 1095) or XGPSSGAPPPS (SEQ ID NO: 1096) to the C-terminus. GLP-1 activity in such analogs can be further increased by modifying the amino acid at position 18, 28 or 29, or at position 18 and 29, as described herein.

A further modest increase in GLP-1 potency is provided by modifying the amino acid at position 10 to be a large, aromatic amino acid residue, optionally Trp.

Reduced activity at the GLP-1 receptor is provided, e.g., by an amino acid modification at position 7 as described herein.

Potency at the GLP-1 receptor can be further enhanced by an alanine substitution for the native arginine at position 18.

Any of the modifications described above in reference to a Class 2 glucagon related peptide which increase GLP-1 receptor activity can be applied individually or in combination. Combinations of the modifications that increase GLP-1 receptor activity generally provide higher GLP-1 activity than any of such modifications taken alone. For example, the invention provides glucagon peptides that comprise modifications at position 16, at position 20, and at the C-terminal carboxylic acid group, optionally with a covalent bond between the amino acids at positions 16 and 20; glucagon peptides that comprise modifications at position 16 and at the C-terminal carboxylic acid group; glucagon peptides that comprise modifications at positions 16 and 20, optionally with a covalent bond between the amino acids at positions 16 and 20; and glucagon peptides that comprise modifications at position 20 and at the C-terminal carboxylic acid group.

Modifications that Improve DPP-IV Resistance

Modifications at position 1 and/or 2 can increase the peptide's resistance to dipeptidyl peptidase IV (DPP IV) cleavage. For example, position 1 and/or position 2 may be substituted with a DPP-IV resistant amino acid as described herein. In some embodiments, the amino acid at position 2 is substituted with N-methyl alanine.

It was observed that modifications at position 2 (e.g. Aib at position 2) and in some cases modifications at position 1 (e.g., DMIA at position 1) may reduce glucagon activity, sometimes significantly; surprisingly, this reduction in glucagon activity can be restored by stabilizing the alpha-helix structure in the C-terminal portion of glucagon (around amino acids 12-29), e.g., through formation of a covalent bond between the side chains of two amino acids, as described herein. In some embodiments, the covalent bond is between amino acids at positions "i" and "i+4", or positions "j" and "j+3", e.g., between positions 12 and 16, 16 and 20, 20 and 24, 24 and 28, or 17 and 20. In exemplary embodiments, this covalent bond is a lactam bridge between a glutamic acid at position 16 and a lysine at position 20. In some embodiments, this covalent bond is an intramolecular bridge other than a lactam bridge, as described herein.

Modifications that Reduce Degradation

In yet further exemplary embodiments, any of the Class 2 glucagon related peptides can be further modified to improve stability by modifying the amino acid at position 15 and/or 16 of SEQ ID NO: 1001 to reduce degradation of the peptide over time, especially in acidic or alkaline buffers. Such modifications reduce cleavage of the Asp15-Ser16 peptide bond. In exemplary embodiments, the amino acid modification at position 15 is a deletion or substitution of Asp with glutamic acid, homoglutamic acid, cysteic acid or homocysteic acid. In other exemplary embodiments, the amino acid modification at position 16 is a deletion or substitution of Ser with Thr or Aib. In other exemplary embodiments, Ser at position 16 is substituted with glutamic acid or with another negatively charged amino acid having a side chain with a length of 4 atoms, or alternatively with any one of glutamine, homoglutamic acid, or homocysteic acid.

In some embodiments, the methionine residue present at position 27 of the native peptide is modified, e.g. by deletion or substitution. Such modifications may prevent oxidative degradation of the peptide. In some embodiments, the Met at position 27 is substituted with leucine, isoleucine or norleucine. In some specific embodiments, Met at position 27 is substituted with leucine or norleucine.

In some embodiments, the Gln at position 20 and/or 24 is modified, e.g. by deletion or substitution. Such modifications can reduce degradation that occurs through deamidation of Gln. In some embodiments, the Gln at position 20 and/or 24 is substituted with Ser, Thr, Ala or Aib. In some embodiments the Gln at position 20 and/or 24 is substituted with Lys, Arg, Orn, or Citrulline.

In some embodiments, the Asp at position 21 is modified, e.g. by deletion or substitution. Such modifications can reduce degradation that occurs through dehydration of Asp to form a cyclic succinimide intermediate followed by isomerization to iso-aspartate. In some embodiments, position 21 is substituted with Glu, homoglutamic acid or homocysteic acid. In some specific embodiments, position 21 is substituted with Glu.

Stabilization of the Alpha Helix Structure

Stabilization of the alpha-helix structure in the C-terminal portion of the Class 2 glucagon related peptide (around amino acids 12-29) provides enhanced GLP-1 and/or GIP activity and restores glucagon activity which has been reduced by amino acid modifications at positions 1 and/or 2. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). Stabilization of the alpha-helix structure of a GIP agonist may be accomplished as described herein.

Acylation and Alkylation

In accordance with some embodiments, the glucagon peptides disclosed herein are modified to comprise an acyl group or alkyl group, e.g., an acyl or alkyl group which is non-native to a naturally-occurring amino acid as described herein. Acylation or alkylation can increase the half-life of the glucagon peptides in circulation. Acylation or alkylation can advantageously delay the onset of action and/or extend the duration of action at the glucagon and/or GLP-1 receptors and/or improve resistance to proteases such as DPP-IV and/or improve solubility. Activity at the glucagon and/or GLP-1 and/or GIP receptors of the glucagon peptide may be maintained after acylation. In some embodiments, the potency of the acylated glucagon peptides is comparable to the unacylated versions of the glucagon peptides. Class 2 glucagon related peptides may be acylated or alkylated at the same amino acid position where a hydrophilic moiety is linked, or at a different amino acid position, as described herein.

In some embodiments, the invention provides a glucagon peptide modified to comprise an acyl group or alkyl group covalently linked to the amino acid at position 10 of the glucagon peptide. The glucagon peptide may further comprise a spacer between the amino acid at position 10 of the glucagon peptide and the acyl group or alkyl group. In some embodiments, the acyl group is a fatty acid or bile acid, or salt thereof, e.g. a C4 to C30 fatty acid, a C8 to C24 fatty acid, cholic acid, a C4 to C30 alkyl, a C8 to C24 alkyl, or an alkyl comprising a steroid moiety of a bile acid. The spacer is any moiety with suitable reactive groups for attaching acyl or alkyl groups. In exemplary embodiments, the spacer comprises an amino acid, a dipeptide, a tripeptide, a hydrophilic bifunctional, or a hydrophobic bifunctional spacer. In some embodiments, the spacer is selected from the group consisting of: Trp, Glu, Asp, Cys and a spacer comprising $NH_2(CH_2CH_2O)_n(CH_2)_mCOOH$, wherein m is any integer from 1 to 6 and n is any integer from 2 to 12. Such acylated or alkylated glucagon peptides may also further comprise a hydrophilic moiety, optionally a polyethylene glycol. Any of the foregoing glucagon peptides may comprise two acyl groups or two alkyl groups, or a combination thereof.

Conjugates and Fusions

The GIP agonist can be linked, optionally via covalent bonding and optionally via a linker, to a conjugate moiety as described herein.

In other embodiments, the second peptide is XGPSSGAPPPS (SEQ ID NO: 1096), wherein X is selected from one of the 20 common amino acids, e.g., glutamic acid, aspartic acid or glycine. In some embodiments X represents an amino acid, for example Cys, that further comprises a hydrophilic moiety covalently linked to the side chain of that amino acid. Such C-terminal extensions improve solubility and also can improve GIP or GLP-1 activity. In some embodiments wherein the glucagon peptide further comprises a carboxy terminal extension, the carboxy terminal amino acid of the extension ends in an amide group or an ester group rather than a carboxylic acid.

In some embodiments, e.g., in glucagon peptides which comprise the C-terminal extension, the threonine at position 29 of the native glucagon peptide is replaced with a glycine. For example, a glucagon peptide having a glycine substitution for threonine at position 29 and comprising the C-terminal extension of GPSSGAPPPS (SEQ ID NO: 1095) is four times as potent at the GLP-1 receptor as native glucagon modified to comprise the same C-terminal extension. This T29G substitution can be used in conjunction with other modifications disclosed herein to enhance the affinity of the glucagon peptides for the GLP-1 receptor. For example, the T29G substitution can be combined with the S16E and N20K amino acid substitutions, optionally with a lactam bridge between amino acids 16 and 20, and optionally with addition of a PEG chain as described herein.

In some embodiments an amino acid is added to the C-terminus, and the additional amino acid is selected from the group consisting of glutamic acid, aspartic acid and glycine.

Modifications that Enhance Solubility

In another embodiment, the solubility of any of the glucagon peptides can be improved by amino acid substitutions and/or additions that introduce a charged amino acid into the C-terminal portion of the peptide, preferably at a position C-terminal to position 27 of SEQ ID NO: 1001. Optionally, one, two or three charged amino acids may be introduced within the C-terminal portion, preferably C-terminal to position 27. In some embodiments the native amino acid(s) at positions 28 and/or 29 are substituted with one or two charged amino acids, and/or in a further embodiment one to three charged amino acids are also added to the C-terminus of the peptide. In exemplary embodiments, one, two or all of the charged amino acids are negatively charged. In some embodiments, the negatively charged (acidic amino acid) is aspartic acid or glutamic acid.

Additional modifications, e.g. conservative substitutions, may be made to the glucagon peptide that still allow it to retain GIP activity (and optionally GLP-1 activity and/or glucagon activity).

Other Modifications

Any of the modifications described above in reference to a Class 2 peptide which increase or decrease GIP activity, which increase or decrease glucagon receptor activity, and which increase GLP-1 receptor activity can be applied individually or in combination. Any of the modifications described above in reference to a Class 2 glucagon related peptide can also be combined with other modifications that confer other desirable properties, such as increased solubility and/or stability and/or duration of action, as described herein with regard to Class 2 glucagon related peptides. Alternatively, any of the modifications described above in reference to Class 2 glucaton related peptides can be combined with other modifications described herein in reference to Class 2 glucagon related peptides that do not substantially affect solubility or stability or activity. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, within a C-terminal extension, or at the C-terminal amino acid of the peptide, (C) Increasing solubility and/or duration of action or half-life in circulation and/or delaying the onset of action by acylation or alkylation of the glucagon peptide, as described herein;

(D) Increasing duration of action or half-life in circulation through introducing resistance to dipeptidyl peptidase IV (DPP IV) cleavage by modification of the amino acid at position 1 or 2 as described herein.

(E) Increasing stability by modification of the Asp at position 15, for example, by deletion or substitution with glutamic acid, homoglutamic acid, cysteic acid or homocysteic acid. Such modifications can reduce degradation or cleavage at a pH within the range of 5.5 to 8, for example, retaining at least 75%, 80%, 90%, 95%, 96%, 97%, 98% or 99%, up to 100% of the original peptide after 24 hours at 25° C. Such modifications reduce cleavage of the peptide bond between Asp15-Ser16.

(F) Increasing stability by modification of the Ser at position 16, for example by substitution with Thr or Aib. Such modifications also reduce cleavage of the peptide bond between Asp15-Ser16.

(G) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ser, Thr, Ala or Aib. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(H) Non-conservative or conservative substitutions, additions or deletions that do not substantially affect activity, for example, conservative substitutions at one or more of positions 2, 5, 9, 10, 11, 12, 13, 14, 15, 16, 17, 18, 19, 20, 21, 24, 27, 28 or 29; substitution of one or more of these positions with Ala; deletion of amino acids at one or more of positions 27, 28 or 29; or deletion of amino acid 29 optionally combined with a C-terminal amide or ester in place of the C-terminal carboxylic acid group; substitution of Lys at position 12 with Arg; substitution of Tyr at position 10 with Val or Phe;

Preservation of activity after pegylation is provided by the addition of GPSSGAPPPS (SEQ ID NO: 1095) to the C-terminus.

Some positions of the native glucagon peptide can be modified while retaining at least some of the activities of the parent peptide. Accordingly, applicants anticipate that one or more of the amino acids located at positions at positions 2, 5, 10, 11, 12, 13, 14, 17, 18, 19, 20, 21, 24, 27, 28 or 29 can be substituted with an amino acid different from that present in the native glucagon peptide, and still retain activity at the glucagon receptor.

In some embodiments, position 18 is substituted with an amino acid selected from the group consisting of Ala, Ser, or Thr. In some embodiments the amino acid at position 20 is substituted with Ser, Thr, Lys, Arg, Orn, Citrulline or Aib. In some embodiments, position 21 is substituted with Glu, homoglutamic acid or homocysteic acid. In some embodiments, the glucagon peptide comprises 1 to 10 amino acid modifications selected from positions 16, 17, 18, 20, 21, 23, 24, 27, 28 and 29. In exemplary embodiments, the modifications are one or more amino acid substitutions selected from the group consisting of Gln17, Ala18, Glu21, Ile23, Ala24, Val27 and Gly29. In some embodiments, 1 to 2 amino acids selected from positions 17-26 differ from the parent peptide. In other embodiments, 1 to 2 amino acids selected from positions 17-22 differ from the parent peptide. In yet other embodiments, the modifications are Gln17, Ala18, Glu21, Ile23 and Ala24.

In some embodiments, one or more amino acids is added to the carboxy terminus of the glucagon peptide. The amino acid is typically selected from one of the 20 common amino acids, and in some embodiments the amino acid has an amide group in place of the carboxylic acid of the native amino acid. In exemplary embodiments the added amino acid is selected from the group consisting of glutamic acid and aspartic acid and glycine.

Other Modifications that do not Destroy Activity Include W10 or R20.

In some embodiments, the Class 2 glucagon related peptides disclosed herein are modified by truncation of the C-terminus by one or two amino acid residues yet retain similar activity and potency at the glucagon, GLP-1 and/or GIP receptors. In this regard, the amino acid at position 29 and/or 28 can be deleted.

Exemplary Embodiments

In accordance with some embodiments of the invention, the analog of glucagon (SEQ ID NO: 1001) having GIP agonist activity comprises SEQ ID NO: 1001 with (a) an amino acid modification at position 1 that confers GIP agonist activity, (b) a modification which stabilizes the alpha helix structure of the C-terminal portion (amino acids 12-29) of the analog, and (c) optionally, 1 to 10 (e.g., 1, 2, 3, 4, 5, 6, 7, 8, 9, 10) further amino acid modifications. In some embodiments, the analog exhibits at least about 1% activity of native GIP at the GIP receptor or any other activity level at the GIP receptor described herein.

In certain embodiments, the modification which stabilizes the alpha helix structure is one which provides or introduces an intramolecular bridge, including, for example, a covalent intramolecular bridge, such as any of those described herein. The covalent intramolecular bridge in some embodiments is a lactam bridge. The lactam bridge of the analog of these embodiments can be a lactam bridge as described herein. See, e.g., the teachings of lactam bridges under the section "Stabilization of the Alpha Helix Structure." For example, the lactam bridge may be one which is between the side chains of amino acids at positions i and i+4 or between the side chains of amino acids at positions j and j+3, wherein i is 12, 13, 16, 17, 20 or 24, and wherein j is 17. In certain embodiments, the lactam bridge can be between the amino acids at positions 16 and 20, wherein one of the amino acids at positions 16 and 20 is substituted with Glu and the other of the amino acids at positions 16 and 20 is substituted with Lys.

In alternative embodiments, the modification which stabilizes the alpha helix structure is the introduction of one, two, three, or four α,α-disubstituted amino acids at position(s) 16, 20, 21, and 24 of the analog. In some embodiments, the α,α-disubstituted amino acid is Aib. In certain aspects, the α,α-disubstituted amino acid (e.g., Aib) is at position 20 and the amino acid at position 16 is substituted with a positive-charged amino acid, such as, for example, an amino acid of Formula IV, which is described herein. The amino acid of Formula IV may be homoLys, Lys, Orn, or 2,4-diaminobutyric acid (Dab).

In specific aspects of the invention, the amino acid modification at position 1 is a substitution of His with an amino acid lacking an imidazole side chain, e.g. a large, aromatic amino acid (e.g., Tyr).

In certain aspects, the analog of glucagon comprises amino acid modifications at one, two or all of positions 27, 28 and 29. For example, the Met at position 27 can be substituted with a large aliphatic amino acid, optionally Leu, the Asn at position 28 can be substituted with a small aliphatic amino acid, optionally Ala, the Thr at position 29 can be substituted with a small aliphatic amino acid, optionally Gly, or a combination of two or three of the foregoing. In specific embodiments, the analog of glucagon comprises Leu at position 27, Ala at position 28, and Gly or Thr at position 29.

In certain embodiments of the invention, the analog of glucagon comprises an extension of 1 to 21 amino acids C-terminal to the amino acid at position 29. The extension can comprise the amino acid sequence of SEQ ID NO: 1095 or 1096, for instance. Additionally or alternatively, the analog of glucagon can comprise an extension of which 1-6 amino acids of the extension are positive-charged amino acids. The positive-charged amino acids may be amino acids of Formula IV, including, but not limited to Lys, homoLys, Orn, and Dab.

The analog of glucagon in some embodiments is acylated or alkylated as described herein. For instance, the acyl or alkyl group may be attached to the analog of glucagon, with or without a spacer, at position 10 or 40 of the analog, as further described herein. The analog may additionally or alternatively be modified to comprise a hydrophilic moiety as further described herein. Furthermore, in some embodiments, the analog comprises any one or a combination of the following modifications:

(a) Ser at position 2 substituted with D-Ser, Ala, D-Ala, Gly, N-methyl-Ser, Aib, Val, or α-amino-N-butyric acid;

(b) Tyr at position 10 substituted with Trp, Lys, Orn, Glu, Phe, or Val:

(c) Linkage of an acyl group to a Lys at position 10;

(d) Lys at position 12 substituted with Arg or Ile;

(e) Ser at position 16 substituted with Glu, Gln, homoglutamic acid, homocysteic acid, Thr, Gly, or Aib;

(f) Arg at position 17 substituted with Gln;

(g) Arg at position 18 substituted with Ala, Ser, Thr, or Gly;

(h) Gln at position 20 substituted with Ser, Thr, Ala, Lys, Citrulline, Arg, Orn, or Aib;

(i) Asp at position 21 substituted with Glu, homoglutamic acid, homocysteic acid;

(j) Val at position 23 substituted with Ile;

(k) Gln at position 24 substituted with Asn, Ser, Thr, Ala, or Aib;

(l) and a conservative substitution at any of positions 2 5, 9, 10, 11, 12. 13, 14, 15, 16, 8 19 20, 21. 24, 27, 28, and 29.

In exemplary embodiments, the analog of glucagon (SEQ ID NO: 1001) having GIP agonist activity comprises the following modifications:

(a) an amino acid modification at position 1 that confers GIP agonist activity, (b) a lactam bridge between the side chains of amino acids at positions i and i+4 or between the side chains of amino acids at positions j and j+3, wherein i is 12, 13, 16, 17, 20 or 24, and wherein j is 17, (c) amino acid modifications at one, two or all of positions 27, 28 and 29, e.g., amino acid modifications at position 27 and/or 28, and (d) 1-9 or 1-6 further amino acid modifications, e.g. 1, 2, 3, 4, 5, 6, 7, 8 or 9 further amino acid modifications, and the $EC_{50}$ of the analog for GIP receptor activation is about 10 nM or less.

The lactam bridge of the analog of these embodiments can be a lactam bridge as described herein. See, e.g., the teachings of lactam bridges under the section "Stabilization of the Alpha Helix Structure." For example, the lactam bridge can be between the amino acids at positions 16 and 20, wherein one of the amino acids at positions 16 and 20 is substituted with Glu and the other of the amino acids at positions 16 and 20 is substituted with Lys.

In accordance with these embodiments, the analog can comprise, for example, the amino acid sequence of any of SEQ ID NOs: 1005-1094.

In other exemplary embodiments, the analog of glucagon (SEQ ID NO: 1001) having GIP agonist activity comprises the following modifications:

(a) an amino acid modification at position 1 that confers GIP agonist activity, (b) one, two, three, or all of the amino acids at positions 16, 20, 21, and 24 of the analog is substituted with an α,α-disubstituted amino acid, (c) amino acid modifications at one, two or all of positions 27, 28 and 29, e.g., amino acid modifications at position 27 and/or 28, and (d) 1-9 or 1-6 further amino acid modifications, e.g. 1, 2, 3, 4, 5, 6, 7, 8 or 9 further amino acid modifications, and the $EC_{50}$ of the analog for GIP receptor activation is about 10 nM or less.

The α,α-disubstituted amino acid of the analog of these embodiments can be any α,α-disubstituted amino acid, including, but not limited to, amino iso-butyric acid (Aib), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the α,α-disubstituted amino acid is Aib. In certain embodiments, the amino acid at position 20 is substituted with an α,α-disubstituted amino acid, e.g., Aib.

In accordance with these embodiments, the analog can comprise, for example, the amino acid sequence of any of SEQ ID NOs: 1099-1141, 1144-1164, 1166-1169, and 1173-1178.

In yet other exemplary embodiments, the analog of glucagon (SEQ ID NO: 1001) having GIP agonist activity comprises the following modifications:

(a) an amino acid modification at position 1 that confers GIP agonist activity, (b) an amino acid substitution of Ser at position 16 with an amino acid of Formula IV:

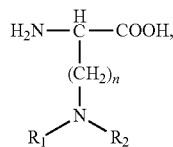

[Formula IV]

wherein n is 1 to 16, or 1 to 10, or 1 to 7, or 1 to 6, or 2 to 6, each of R1 and R2 is independently selected from the group consisting of H, C1-C18 alkyl, (C1-C18 alkyl)OH, (C1-C18 alkyl)NH2, (C1-C18 alkyl)SH, (C0-C4 alkyl)(C3-C6)cycloalkyl, (C0-C4 alkyl)(C2-C5 heterocyclic), (C0-C4 alkyl)(C6-C10 aryl)R7, and (C1-C4 alkyl)(C3-C9 heteroaryl), wherein R7 is H or OH, and the side chain of the amino acid of Formula IV comprises a free amino group, (c) an amino acid substitution of the Gln at position 20 with an alpha, alpha-disubstituted amino acid, (d) amino acid modifications at one, two or all of positions 27, 28 and 29, e.g., amino acid modifications at position 27 and/or 28, and (e) 1-9 or 1-6 further amino acid modifications, e.g. 1, 2, 3, 4, 5, 6, 7, 8 or 9 further amino acid modifications, and the $EC_{50}$ of the analog for GIP receptor activation is about 10 nM or less.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

The alpha, alpha-disubstituted amino acid of the analog of these embodiments may be any alpha, alpha-disubstituted amino acid, including, but not limited to, amino iso-butyric acid (Aib), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is Aib.

In accordance with these embodiments, the analog can comprise, for example, the amino acid sequence of any of SEQ ID NOs: 1099-1165.

In yet other exemplary embodiments, the analog of glucagon (SEQ ID NO: 1001) having GIP agonist activity comprises:

(a) an amino acid modification at position 1 that confers GIP agonist activity, and (b) an extension of about 1 to about 21 amino acids C-terminal to the amino acid at position 29, wherein at least one of the amino acids of the extension is acylated or alkylated, wherein the $EC_{50}$ of the analog for GIP receptor activation is about 10 nM or less.

In some embodiments, the acylated or alkylated amino acid is an amino acid of Formula I, II, or III. In more specific embodiments, the amino acid of Formula I is Dab, Orn, Lys, or homoLys. Also, in some embodiments, the extension of about 1 to about 21 amino acids comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In some embodiments, the analog having GIP agonist activity further comprises amino acid modifications at one, two or all of positions 27, 28 and 29, e.g., amino acid modifications at position 27 and/or 28.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

In certain aspects, the analog does not comprise an amino acid modification at position 1 which modification confers GIP agonist activity. In some aspects, the amino acid at position 1 is not a large, aromatic amino acid, e.g., Tyr. In some embodiments, the amino acid at position 1 is an amino acid comprising an imidazole ring, e.g., His, analogs of His. In certain embodiments, the analog is not any of the compounds disclosed in International Patent Application Publication No.

WO 2010/011439. In certain aspects, the analog comprises the amino acid sequence of any of SEQ ID NOs: 1263-1275.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:

(i) Ser at position 2 substituted with D-Ser, Ala, D-Ala, Gly, N-methyl-Ser, Aib, Val, or α-amino-N-butyric acid;

(ii) Tyr at position 10 substituted with Trp, Lys, Orn, Glu, Phe, or Val;

(iii) Linkage of an acyl group to a Lys at position 10;

(iv) Lys at position 12 substituted with Arg;

(v) Ser at position 16 substituted with Glu, Gln, homoglutamic acid, homocysteic acid, Thr, Gly, or Aib;

(vi) Arg at position 17 substituted with Gln;

(vii) Arg at position 18 substituted with Ala, Ser, Thr, or Gly;

(viii) Gln at position 20 substituted with Ala, Ser, Thr, Lys, Citrulline, Arg, Orn, or Aib;

(ix) Asp at position 21 substituted with Glu, homoglutamic acid, homocysteic acid;

(x) Val at position 23 substituted with Ile;

(xi) Gln at position 24 substituted with Asn, Ala, Ser, Thr, or Aib; and (xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In some embodiments, the hydrophilic moiety is covalently linked to a Lys, Cys, Orn, homocysteine, or acetyl-phenylalanine of the analog. The Lys, Cys, Orn, homocysteine, or acetyl-phenylalanine may be an amino acid that is native to the glucagon sequence (SEQ ID NO: 1001) or it may be an amino acid which is replacing a native amino acid of SEQ ID NO: 1001. In some embodiments, wherein the hydrophilic moiety is attached to a Cys, the linkage to the hydrophilic moiety can comprise the structure

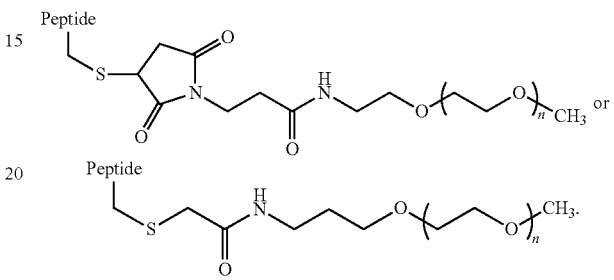

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

With regard to the exemplary embodiments, the analog can comprise a modified amino acid in which the side chain is covalently linked to an acyl or alkyl group (e.g., an acyl or alkyl group which is non-native to a naturally-occurring amino acid). The acylated or alkylated analog can be in accordance with acylated or alkylated peptides described in the section "Acylation and alkylation." In some embodiments, the acyl group is a C4 to a C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group. The acyl or alkyl group may be covalently attached to any amino acid of the analog, including, but not limited to the amino acid at position 10 or 40, or the C-terminal amino acid. In certain embodiments, the analog comprises a C-terminal extension (e.g., an amino acid sequence of SEQ ID NO: 1095) and an addition of an amino acid comprising the acyl or alkyl group, such that the acyl or alkyl group is covalently linked to the analog at position 40. In some embodiments, the acyl or alkyl group is covalently linked to the side chain of an amino acid of Formula I, II, or III, e.g., a Lys residue. The acyl or alkyl group may be covalently linked to an amino acid which is native to the glucagon sequence (SEQ ID NO: 1001) or may be linked to an amino acid which is added to the sequence of SEQ ID NO: 1001 or to the sequence of SEQ ID NO: 1095 followed by SEQ ID NO: 1095 (at the N- or C-terminus) or may be linked to an amino acid which replaces a native amino acid, e.g., the Tyr at position 10 of SEQ ID NO: 1001.

In the above exemplary embodiments, wherein the analog comprises an acyl or alkyl group, the analog may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γ-Glu-γ-Glu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

In still further exemplary embodiments, the analog of glucagon having GIP agonist activity comprises the amino acid sequence according to any one of SEQ ID NOs: 1227, 1228, 1229 or 1230 that further comprises the following modifications:

(a) optionally, an amino acid modification at position 1 that confers GIP agonist activity, (b) an extension of about 1 to about 21 amino acids C-terminal to the amino acid at position 29, wherein at least one of the amino acids of the extension is acylated or alkylated, and (d) up to 6 further amino acid modifications, wherein the $EC_{50}$ of the analog for GIP receptor activation is about 10 nM or less.

In some aspects, the acylated or alkylated amino acid is an amino acid of Formula I, II, or III. In more specific embodiments, the amino acid of Formula I is Dab, Orn, Lys, or homoLys. Also, in some embodiments, the about 1 to about 21 amino acids comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In any of the above exemplary embodiments, the amino acid at position 1 that confers GIP agonist activity can be an amino acid lacking an imidazole side chain. The amino acid at position 1 can, for example, be a large, aromatic amino acid. In some embodiments, the large, aromatic amino acid is any of those described herein, including, for example, Tyr.

The analog of the above exemplary embodiments can further comprise 1-6 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability.

In certain aspects, glucagon analogs described in the above exemplary embodiment, comprise further amino acid modifications at one, two or all of positions 27, 28 and 29. Modifications at these positions can be any of the modifications described herein relative to these positions. For example, relative to SEQ ID NO: 1227, 1228, 1229 or 1230, position 27 can be substituted with a large aliphatic amino acid (e.g., Leu, Ile or norleucine) or Met, position 28 can be substituted with another small aliphatic amino acid (e.g., Gly or Ala) or Asn, and/or position 29 can be substituted with another small aliphatic amino acid (e.g., Ala or Gly) or Thr. Alternatively, the analog can comprise such amino acid modifications at position 27 and/or 28.

The analog can further comprise one or more of the following additional modifications:

(i) the amino acid at position 2 is any one of D-Ser, Ala, D-Ala, Gly, N-methyl-Ser, Aib, Val, or α-amino-N-butyric acid;

(ii) the amino acid at position 10 is Tyr, Trp, Lys, Orn, Glu, Phe, or Val;

(iii) linkage of an acyl group to a Lys at position 10;

(iv) the amino acid at position 12 is Ile, Lys or Arg;

(v) the amino acid at position 16 is any one of Ser, Glu, Gln, homoglutamic acid, homocysteic acid, Thr, Gly, or Aib;

(vi) the amino acid at position 17 is Gln or Arg;

(vii) the amino acid at position 18 is any one of Ala, Arg, Ser, Thr, or Gly;

(viii) the amino acid at position 20 is any one of Ala, Ser, Thr, Lys, Citrulline, Arg, Orn, or Aib or another alpha, alpha-disubstituted amino acid;

(ix) the amino acid at position 21 is any one of Glu, Asp, homoglutamic acid, homocysteic acid;

(x) the amino acid at position 23 is Val or Ile;

(xi) the amino acid at position 24 is any one of Gln, Asn, Ala, Ser, Thr, or Aib; and (xii) one or more conservative substitutions at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a hydrophilic moiety covalently linked to the analog at position 24.

In some embodiments, the hydrophilic moiety is covalently linked to a Lys, Cys, Orn, homocysteine, or acetyl-phenylalanine of the analog. The Lys, Cys, Orn, homocysteine, or acetyl-phenylalanine may be an amino acid that is native to SEQ ID NO: 1001, 1227, 1228, 1229 or 1230 or it may be a substituted amino acid. In some embodiments, wherein the hydrophilic moiety is linked to a Cys, the linkage may comprise the structure

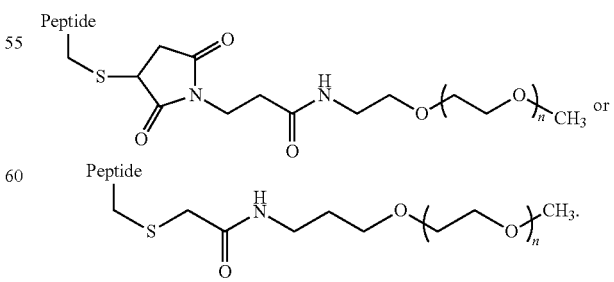

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

With regard to the exemplary embodiments, the analog can comprise a modified amino acid within the C-terminal extension in which the side chain is covalently linked to an acyl or alkyl group. The acylated or alkylated analog can be in accordance with acylated or alkylated peptides described in the section "Acylation and alkylation." In some embodiments, the acyl group is a C4 to a C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group. The acyl or alkyl group may be covalently attached to any amino acid of the analog, including, but not limited to the amino acid at position 10 or 40, or the C-terminal amino acid. In some embodiments, the acyl or alkyl group is covalently linked to the side chain of an amino acid of Formula I, II, or III, e.g., a Lys residue. The acyl or alkyl group is covalently linked to an amino acid which is native to SEQ ID NO: 1001, 1227, 1228, 1229 or 1230 or it may be linked to a substituted amino acid. The acyl or alkyl group is covalently linked to an amino acid which is native to SEQ ID NO: 1095, 1096, 1171 or 1172, or it may be linked to a substituted amino acid.

In the above exemplary embodiments, wherein the analog comprises an acyl or alkyl group, the analog may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γ-Glu-γ-Glu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

In some very specific embodiments, an analog of the invention comprises an amino acid sequence selected from the group consisting of SEQ ID NOs: 1099-1141, 1144-1164, 1166, 1192-1207, 1209-1221 and 1223 or selected from the group consisting of SEQ ID NOs: 1167-1169, 1173-1178 and 1225.

Further, specific examples of analogs of the invention include but are not limited to, any of those referenced in Tables 1-3.

In still further exemplary embodiments, the analog of glucagon having GIP agonist activity comprises an acyl or alkyl group (e.g., an acyl or alkyl group which is non-native to a naturally occurring amino acid), wherein the acyl or alkyl group is attached to a spacer, wherein (i) the spacer is attached to the side chain of the amino acid at position 10 of the analog; or (ii) the analog comprises an extension of 1 to 21 amino acids C-terminal to the amino acid at position 29 and the spacer is attached to the side chain of an amino acid corresponding to one of positions 37-43 relative to SEQ ID NO: 1001, wherein the $EC_{50}$ of the analog for GIP receptor activation is about 10 nM or less.

In such embodiments, the analog may comprise an amino acid sequence of SEQ ID NO: 1001 with (i) an amino acid modification at position 1 that confers GIP agonist activity, (ii) amino acid modifications at one, two, or all of positions 27, 28, and 29, (iii) at least one of:

(A) the analog comprises a lactam bridge between the side chains of amino acids at positions i and i+4 or between the side chains of amino acids at positions j and j+3, wherein i is 12, 13, 16, 17, 20 or 24, and wherein j is 17;

(B) one, two, three, or all of the amino acids at positions 16, 20, 21, and 24 of the analog is substituted with an α,α-disubstituted amino acid; or (C) the analog comprises (i) an amino acid substitution of Ser at position 16 with an amino acid of Formula IV:

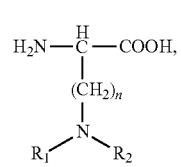

[Formula IV]

wherein n is 1 to 7, wherein each of R1 and R2 is independently selected from the group consisting of H, $C_1$-$C_{18}$ alkyl, ($C_1$-$C_{18}$ alkyl)OH, ($C_1$-$C_{18}$ alkyl)$NH_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl), wherein $R_7$ is H or OH, and the side chain of the amino acid of Formula IV comprises a free amino group; and (ii) an amino acid substitution of the Gln at position 20 with an alpha, alpha-disubstituted amino acid.

and (iv) up to 6 further amino acid modifications.

The alpha, alpha-disubstituted amino acid of the analog of these embodiments may be any alpha, alpha-disubstituted amino acid, including, but not limited to, amino iso-butyric acid (Aib), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is Aib.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:

(i) Ser at position 2 substituted with D-Ser, Ala, D-Ala, Gly, N-methyl-Ser, Aib, Val, or α-amino-N-butyric acid;

(ii) Tyr at position 10 substituted with Trp, Lys, Orn, Glu, Phe, or Val;

(iii) Linkage of an acyl group to a Lys at position 10;

(iv) Lys at position 12 substituted with Arg;

(v) Ser at position 16 substituted with Glu, Gln, homoglutamic acid, homocysteic acid, Thr, Gly, Lys, or Aib;

(vi) Arg at position 17 substituted with Gln;

(vii) Arg at position 18 substituted with Ala, Ser, Thr, or Gly;

(viii) Gln at position 20 substituted with Ala, Ser, Thr, Lys, Citrulline, Arg, Orn, or
Aib;

(ix) Asp at position 21 substituted with Glu, homoglutamic acid, homocysteic acid;

(x) Val at position 23 substituted with Ile;

(xi) Gln at position 24 substituted with Asn, Ala, Ser, Thr, or Aib; and (xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), a deletion of the amino acid(s)C-terminal to the amino acid at position 27 or 28, yielding a 27- or 28-amino acid peptide, or a combination thereof, wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In some embodiments, the hydrophilic moiety is covalently linked to a Lys, Cys, Orn, homocysteine, or acetyl-phenylalanine of the analog. The Lys, Cys, Orn, homocysteine, or acetyl-phenylalanine may be an amino acid that is native to the glucagon sequence (SEQ ID NO: 1001) or it may be an amino acid which is replacing a native amino acid of SEQ ID NO: 1001. In some embodiments, wherein the hydrophilic moiety is attached to a Cys, the linkage to the hydrophilic moiety can comprise the structure

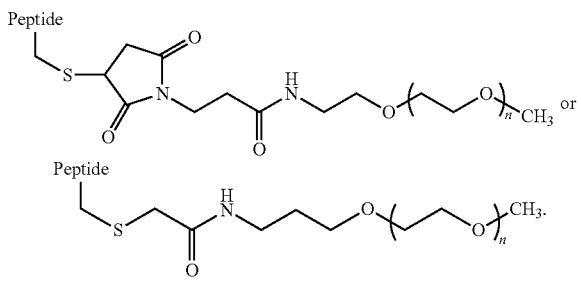

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

In the exemplary embodiments, wherein the analog comprises an acyl or alkyl group, which is attached to the analog via a spacer, the spacer can be any spacer as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γ-Glu-γ-Glu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

The acyl or alkyl group is any acyl or alkyl group as described herein, such as an acyl or alkyl group which is non-native to a naturally occurring amino acid. The acyl or alkyl group in some embodiments is a C4 to C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group, or a C4 to C30 alkyl group. In specific embodiments, the acyl group is a C12 to C18 fatty acyl group (e.g., a C14 or C16 fatty acyl group).

In some embodiments, the extension of about 1 to about 21 amino acids C-terminal to the amino acid at position 29 of the analog comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

The GIP agonist may be a peptide comprising the amino acid sequence of any of the amino acid sequences, e.g., SEQ ID NOs: 1005-1094, optionally with up to 1, 2, 3, 4, or 5 further modifications that retain GIP agonist activity. In certain embodiments, the GIP agonist comprises the amino acids of any of SEQ ID NOs: 1099-1275.

Class 3 Glucagon Related Peptides

In certain embodiments, the glucagon related peptide is a Class 3 glucagon related peptide, which is described herein and in International Patent Application Publication Nos. WO 2009/155258, WO 2008/101017, and U.S. Provisional Application No. 61/288,248 (filed on Dec. 18, 2009) the contents of which are incorporated by reference in their entirety.

Some of the biological sequences referenced in the following section (SEQ ID NOs: 1-656) relating to Class 3 glucagon related peptides are correspond to SEQ ID NOs: 1-656 in International Patent Application Publication No. WO 2009/155258.

Activity

The Class 3 glucagon related peptide can be a peptide that exhibits increased activity at the glucagon receptor, and in further embodiments exhibits enhanced biophysical stability and/or aqueous solubility. In addition, in some embodiments, the Class 3 glucagon related peptide has lost native glucagon's selectivity for the glucagon receptor verses the GLP-1 receptor, and thus represents co-agonists of those two receptors. Selected amino acid modifications within the Class 3 glucagon related peptide can control the relative activity of the peptide at the GLP-1 receptor verses the glucagon receptor. Thus, the Class 3 glucagon related peptide can be a glucagon/GLP-1 co-agonist that has higher activity at the glucagon receptor versus the GLP-1 receptor, a glucagon/GLP-1 co-agonist that has approximately equivalent activity at both receptors, or a glucagon/GLP-1 co-agonist that has higher activity at the GLP-1 receptor versus the glucagon receptor. The latter category of co-agonist can be engineered to exhibit little or no activity at the glucagon receptor, and yet retain ability to activate the GLP-1 receptor with the same or better potency than native GLP-1. Any of these co-agonists may also include modifications that confer enhanced biophysical stability and/or aqueous solubility.

Modifications of the Class 3 glucagon related peptide can be made to produce a glucagon peptide having anywhere from at least about 1% (including at least about 1.5%, 2%, 5%, 7%, 10%, 20%, 30%, 40%, 50%, 60%, 75%, 100%, 125%, 150%, 175%) to about 200% or higher activity at the GLP-1 receptor relative to native GLP-1 and anywhere from at least about 1% (including about 1.5%, 2%, 5%, 7%, 10%, 20%, 30%, 40%, 50%, 60%, 75%, 100%, 125%, 150%, 175%, 200%, 250%, 300%, 350%, 400%, 450%) to about 500% or higher activity at the glucagon receptor relative to native glucagon. The amino acid sequence of native glucagon is SEQ ID NO: 1, the amino acid sequence of GLP-1(7-36) amide is SEQ ID NO: 52, and the amino acid sequence of GLP-1(7-37) acid is SEQ ID NO: 50. In exemplary embodiments, a Class 3 glucagon related peptide may exhibit at least 10% of the activity of native glucagon at the glucagon receptor and at least 50% of the activity of native GLP-1 at the GLP-1 receptor, or at least 40% of the activity of native glucagon at the glucagon receptor and at least 40% of the activity of native GLP-1 at the GLP-1 receptor, or at least 60% of the activity of native glucagon at the glucagon receptor and at least 60% of the activity of native GLP-1 at the GLP-1 receptor.

Selectivity of a Class 3 glucagon related peptide for the glucagon receptor versus the GLP-1 receptor can be described as the relative ratio of glucagon/GLP-1 activity (the peptide's activity at the glucagon receptor relative to native glucagon, divided by the peptide's activity at the GLP-1 receptor relative to native GLP-1). For example, a Class 3 glucagon related peptide that exhibits 60% of the activity of native glucagon at the glucagon receptor and 60% of the activity of native GLP-1 at the GLP-1 receptor has a 1:1 ratio of glucagon/GLP-1 activity. Exemplary ratios of glucagon/GLP-1 activity include about 1:1, 1.5:1, 2:1, 3:1, 4:1, 5:1, 6:1, 7:1, 8:1, 9:1 or 10:1, or about 1:10, 1:9, 1:8, 1:7, 1:6, 1:5, 1:4, 1:3, 1:2, or 1:1.5. As an example, a glucagon/GLP-1 activity ratio of 10:1 indicates a 10-fold selectivity for the glucagon receptor versus the GLP-1 receptor. Similarly, a GLP-1/glucagon activity ratio of 10:1 indicates a 10-fold selectivity for the GLP-1 receptor versus the glucagon receptor.

In some embodiments, the Class 3 glucagon related peptides have about 10% or less of the activity of native glucagon at the glucagon receptor, e.g. about 1-10%, or about 0.1-10%, or greater than about 0.1% but less than about 10%, while exhibiting at least 20% of the activity of GLP-1 at the GLP-1 receptor. For example, exemplary Class 3 glucagon related peptides described herein have about 0.5%, about 1% or about 7% of the activity of native glucagon, while exhibiting at least 20% of the activity of GLP-1 at the GLP-1 receptor.

The Class 3 glucagon related peptide can be a glucagon peptide with increased or decreased activity at the glucagon receptor, or GLP-1 receptor, or both. The Class 3 glucagon related peptide can be a glucagon peptide with altered selectivity for the glucagon receptor versus the GLP-1 receptor.

Thus, as disclosed herein high potency Class 3 glucagon related peptides are provided that also exhibit improved solubility and/or stability. An exemplary high potency Class 3 glucagon related peptide exhibits at least about 200% of the activity of native glucagon at the glucagon receptor, and optionally is soluble at a concentration of at least 1 mg/mL at a pH between 6 and 8, or between 6 and 9, or between 7 and 9 (e.g. pH 7), and optionally retains at least 95% of the original peptide (e.g. 5% or less of the original peptide is degraded or cleaved) after 24 hours at 25° C. As another example, an exemplary Class 3 glucagon related peptide exhibits greater than about 40% or greater than about 60% activity at both the glucagon and the GLP-1 receptors (at a ratio between about 1:3 and 3:1, or between about 1:2 and 2:1), is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Another exemplary Class 3 glucagon related peptide exhibits about 175% or more of the activity of native glucagon at the glucagon receptor and about 20% or less of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Yet another exemplary Class 3 glucagon related peptide exhibits about 10% or less of the activity of native glucagon at the glucagon receptor and at least about 20% of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Yet another exemplary Class 3 glucagon related peptide exhibits about 10% or less but above 0.1%, 0.5% or 1% of the activity of native glucagon at the glucagon receptor and at least about 50%, 60%, 70%, 80%, 90% or 100% or more of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. In some embodiments, such Class 3 glucagon related peptides retain at least 22, 23, 24, 25, 26, 27 or 28 of the naturally occurring amino acids at the corresponding positions in native glucagon (e.g. have 1-7, 1-5 or 1-3 modifications relative to naturally occurring glucagon).

Modifications Affecting Glucagon Activity

Increased activity at the glucagon receptor is provided by an amino acid modification at position 16 of native glucagon (SEQ ID NO: 1). In some embodiments, the Class 3 glucagon related peptide is a glucagon agonist that has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 1) to enhance the peptide's potency at the glucagon receptor. The normally occurring serine at position 16 of native glucagon (SEQ ID NO: 1) can be substituted with select acidic amino acids to enhance the potency of glucagon, in terms of its ability to stimulate cAMP synthesis in a validated in vitro model assay (see Example 2). More particularly, this substitution enhances the potency of the analog at least 2-fold, 4-fold, 5-fold, and up to 10-fold greater at the glucagon receptor. This substitution also enhances the analog's activity at the GLP-1 receptor at least 5-fold, 10-fold, or 15-fold relative to native glucagon, but selectivity is maintained for the glucagon receptor over the GLP-1 receptor.

By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In accordance with some embodiments, the serine residue at position 16 of native glucagon is substituted with an amino acid selected from the group consisting of glutamic acid, glutamine, homoglutamic acid, homocysteic acid, threonine, or glycine. In accordance with some embodiments, the serine residue at position 16 of native glucagon is substituted with an amino acid selected from the group consisting of glutamic acid, glutamine, homoglutamic acid and homocysteic acid, and in some embodiments the serine residue is substituted with glutamic acid.

In some embodiments, the enhanced potency Class 3 glucagon related peptide comprises a peptide of SEQ ID NO: 2, SEQ ID NO: 3, SEQ ID NO: 4, SEQ ID NO: 5, SEQ ID NO: 6, SEQ ID NO: 7 or a glucagon agonist analog of SEQ ID NO: 5. In accordance with some embodiments, a Class 3 glucagon related peptide having enhanced potency at the glucagon receptor relative to wild type glucagon is provided wherein the peptide comprises the sequence of SEQ ID NO: 7, SEQ ID NO: 8, SEQ ID NO: 9 or SEQ ID NO: 10, wherein the glucagon peptide retains its selectivity for the glucagon receptor relative to the GLP-1 receptors. In some embodiments, the Class 3 glucagon related peptide having enhanced specificity for the glucagon receptor comprises the peptide of SEQ ID NO: 8, SEQ ID NO: 9, SEQ ID NO: 10 or a glucagon agonist analog thereof, wherein the carboxy terminal amino acid retains its native carboxylic acid group. In accordance with some embodiments, a Class 3 glucagon related peptide comprises the sequence of $NH_2$—His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-COOH (SEQ ID NO: 10), wherein the peptide exhibits approximately five-fold enhanced potency at the glucagon receptor, relative to native glucagon as measured by the in vitro cAMP assay of Example 2.

Glucagon receptor activity can be reduced, maintained, or enhanced by an amino acid modification at position 3, e.g. substitution of the naturally occurring glutamine at position 3. In some embodiments, substitution of the amino acid at position 3 with an acidic, basic, or hydrophobic amino acid (glutamic acid, ornithine, norleucine) has been shown to substantially reduce or destroy glucagon receptor activity. The analogs that are substituted with, for example, glutamic acid, ornithine, or norleucine have about 10% or less of the activity of native glucagon at the glucagon receptor, e.g. about 1-10%, or about 0.1-10%, or greater than about 0.1% but less than about 10%, while exhibiting at least 20% of the activity of GLP-1 at the GLP-1 receptor. For example, exemplary analogs described herein have about 0.5%, about 1% or about 7% of the activity of native glucagon, while exhibiting at least 20% of the activity of GLP-1 at the GLP-1 receptor. In particular, any of the Class 3 glucagon related peptides, including glucagon analogs, glucagon agonist analogs, glucagon co-agonists, and glucagon/GLP-1 co-agonist molecules, described herein may be modified to contain a modification at position 3, e.g., Gln substituted with Glu, to produce a peptide with high selectivity, e.g., tenfold selectivity, for the GLP-1 receptor as compared to the selectivity for the glucagon receptor.

In another embodiment, the naturally occurring glutamine at position 3 of any of the Class 3 glucagon peptides can be substituted with a glutamine analog without a substantial loss of activity at the glucagon receptor, and in some cases, with an enhancement of glucagon receptor activity, as described herein. In specific embodiments, the amino acid at position 3 is substituted with Dab(Ac). For example, glucagon agonists can comprise the amino acid sequence of SEQ ID NO: 595, SEQ ID NO: 601 SEQ ID NO: 603, SEQ ID NO: 604, SEQ ID NO: 605, and SEQ ID NO: 606.

It was observed that modifications at position 2 (e.g. Aib at position 2) and in some cases modifications at position 1 may reduce glucagon activity. This reduction in glucagon activity can be restored by stabilizing the alpha-helix in the C-terminal portion of glucagon, e.g. through means described herein, for example, through a covalent bond between the side chains of the amino acids at positions "i" and "i+4", e.g., 12 and 16, 16 and 20, or 20 and 24. In some embodiments, this covalent bond is a lactam bridge between a glutamic acid at position 16 and a lysine at position 20. In some embodiments, this covalent bond is an intramolecular bridge other than a lactam bridge. For example, suitable covalent bonding methods include any one or more of olefin metathesis, lanthionine-based cyclization, disulfide bridge or modified sulfur-containing bridge formation, the use of a, co-diaminoalkane tethers, the formation of metal-atom bridges, and other means of peptide cyclization.

Modifications Affecting GLP-1 Activity

Enhanced activity at the GLP-1 receptor is provided by replacing the carboxylic acid of the C-terminal amino acid with a charge-neutral group, such as an amide or ester. In some embodiments, these Class 3 glucagon related peptides comprise a sequence of SEQ ID NO: 20, wherein the carboxy terminal amino acid has an amide group in place of the carboxylic acid group found on the native amino acid. These Class 3 glucagon related peptides have strong activity at both the glucagon and GLP-1 receptors and thus act as co-agonists at both receptors. In accordance with some embodiments, the Class 3 glucagon related peptide is a glucagon and GLP-1 receptor co-agonist, wherein the peptide comprises the sequence of SEQ ID NO: 20, wherein the amino acid at position 28 is Asn or Lys and the amino acid at position 29 is Thr-amide Increased activity at the GLP-1 receptor is provided by modifications that stabilize the alpha helix in the C-terminal portion of glucagon (e.g. around residues 12-29).

In some embodiments, such modifications permit formation of an intramolecular bridge between the side chains of two amino acids that are separated by three intervening amino acids (i.e., an amino acid at position "i" and an amino acid at position "i+4", wherein i is any integer between 12 and 25), by two intervening amino acids, i.e., an amino acid at position "j" and an amino acid at position "j+3," wherein j is any integer between 12 and 27, or by six intervening amino acids, i.e., an amino acid at position "k" and an amino acid at position "k+7," wherein k is any integer between 12 and 22. In exemplary embodiments, the bridge or linker is about 8 (or about 7-9) atoms in length and forms between side chains of amino acids at positions 12 and 16, or at positions 16 and 20, or at positions 20 and 24, or at positions 24 and 28. The two amino acid side chains can be linked to one another through non-covalent bonds, e.g., hydrogen-bonding, ionic interactions, such as the formation of salt bridges, or by covalent bonds.

In accordance with some embodiments, the Class 3 glucagon related peptide exhibits glucagon/GLP-1 receptor co-agonist activity and comprises an amino acid sequence selected from the group consisting of SEQ ID NO: 11, 47, 48 and 49. In some embodiments, the side chains are covalently bound to one another, and in some embodiments the two amino acids are bound to one another to form a lactam ring.

In accordance with some embodiments, the Class 3 glucagon related peptide comprises SEQ ID NO: 45, wherein at least one lactam ring is formed between the side chains of an amino acid pair selected from the group consisting of amino acid pairs 12 and 16, 16 and 20, 20 and 24 or 24 and 28. In some embodiments, the Class 3 glucagon related peptide comprises a glucagon peptide analog of SEQ ID NO: 20, wherein the peptide comprises an intramolecular lactam bridge formed between amino acid positions 12 and 16 or between amino acid positions 16 and 20. In some embodiments, the Class 3 glucagon related peptide comprises the sequence of SEQ ID NO: 20, wherein an intramolecular lactam bridge is formed between amino acid positions 12 and 16, between amino acid positions 16 and 20, or between amino acid positions 20 and 24 and the amino acid at position 29 is glycine, wherein the sequence of SEQ ID NO: 29 is linked to the C-terminal amino acid of SEQ ID NO: 20. In a further embodiment, the amino acid at position 28 is aspartic acid.

In some specific embodiments, stabilization of the alpha helix structure in the C-terminal portion of the Class 3 glucagon related peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization are used to stabilize the alpha helix.

Furthermore, enhanced activity at the GLP-1 receptor may be achieved by stabilizing the alpha-helix structure in the C-terminal portion of the glucagon peptide (around amino acids 12-29) through purposeful introduction of one or more α,α-disubstituted amino acids at positions that retain the desired activity. Such peptides may be considered herein as a peptide lacking an intramolecular bridge. In some aspects, stabilization of the alpha-helix is accomplished in this manner without introduction of an intramolecular bridge such as a salt bridge or covalent bond. In some embodiments, one, two, three, four or more of positions 16, 17, 18, 19, 20, 21, 24 or 29 of a glucagon peptide is substituted with an α,α-disubstituted amino acid. For example, substitution of position 16 of the Class 3 glucagon related peptide with amino iso-butyric acid (Aib) enhances GLP-1 activity, in the absence of a salt bridge or lactam. In some embodiments, one, two, three or more of positions 16, 20, 21 or 24 are substituted with Aib.

Enhanced activity at the GLP-1 receptor may be achieved by an amino acid modification at position 20. In some embodiments, the glutamine at position 20 is replaced with another hydrophilic amino acid having a side chain that is either charged or has an ability to hydrogen-bond, and is at least about 5 (or about 4-6) atoms in length, for example, lysine, citrulline, arginine, or ornithine.

Increased activity at the GLP-1 receptor is demonstrated in Class 3 glucagon related peptides comprising the C-terminal extension of SEQ ID NO: 26. GLP-1 activity in such Class 3 glucagon related peptides comprising SEQ ID NO: 26 can be further increased by modifying the amino acid at position 18, 28 or 29, or at position 18 and 29, as described herein.

A further modest increase in GLP-1 potency may be achieved by modifying the amino acid at position 10 to be Trp.

Combinations of the modifications that increase GLP-1 receptor activity may provide higher GLP-1 activity than any of such modifications taken alone. For example, the Class 3 glucagon related peptides can comprise modifications at position 16, at position 20, and at the C-terminal carboxylic acid group, optionally with a covalent bond between the amino acids at positions 16 and 20; can comprise modifications at position 16 and at the C-terminal carboxylic acid group; can comprise modifications at positions 16 and 20, optionally with a covalent bond between the amino acids at positions 16 and 20; or can comprise modifications at position 20 and at the C-terminal carboxylic acid group; optionally with the proviso that the amino acid at position 12 is not Arg; or optionally with the proviso that the amino acid at position 9 is not Glu.

Modifications Affecting Solubility

Addition of Hydrophilic Moieties

The Class 3 glucagon related peptides can be further modified to improve the peptide's solubility and stability in aqueous solutions at physiological pH, while retaining the high biological activity relative to native glucagon. Hydrophilic moieties as discussed herein can be attached to the Class 3 glucagon related peptide as further discussed herein.

In accordance with some embodiments, introduction of hydrophilic groups at positions 17, 21, and 24 of the Class 3 glucagon related peptide comprising SEQ ID NO: 9 or SEQ ID NO: 10 are anticipated to improve the solubility and stability of the high potency glucagon analog in solutions having a physiological pH. Introduction of such groups also increases duration of action, e.g. as measured by a prolonged half-life in circulation.

In some embodiments, the Class 3 glucagon related peptide comprises a sequence selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18 and SEQ ID NO: 19, wherein the side chain of an amino acid residue at one of position 16, 17, 21 or 24 of said Class 3 glucagon related peptide further comprises a polyethylene glycol chain, having a molecular weight selected from the range of about 500 to about 40,000 Daltons. In some embodiments, the polyethylene glycol chain has a molecular weight selected from the range of about 500 to about 5,000 Daltons. In another embodiment, the polyethylene glycol chain has a molecular weight of about 10,000 to about 20,000 Daltons. In yet other exemplary embodiments the polyethylene glycol chain has a molecular weight of about 20,000 to about 40,000 Daltons.

Suitable hydrophilic moieties include any water soluble polymers known in the art, including the hydrophilic moieties described herein, homo- or co-polymers of PEG, and a monomethyl-substituted polymer of PEG (mPEG). In accordance with some embodiments the hydrophilic group comprises a polyethylene (PEG) chain. More particularly, in some embodiments, the Class 3 glucagon related peptide comprises the sequence of SEQ ID NO: 6 or SEQ ID NO: 7 wherein a PEG chain is covalently linked to the side chains of amino acids present at positions 21 and 24 of the Class 3 glucagon related peptide and the carboxy terminal amino acid of the Class 3 glucagon related peptide has the carboxylic acid group. In accordance with some embodiments, the polyethylene glycol chain has an average molecular weight selected from the range of about 500 to about 10,000 Daltons.

In accordance with some embodiments, the pegylated Class 3 glucagon related peptide comprises two or more polyethylene glycol chains covalently bound to the Class 3 glucagon related peptide wherein the total molecular weight of the glucagon chains is about 1,000 to about 5,000 Daltons. In some embodiments the pegylated glucagon agonist comprises a peptide consisting of SEQ ID NO: 5 or a glucagon agonist analog of SEQ ID NO: 5, wherein a PEG chain is covalently linked to the amino acid residue at position 21 and at position 24, and wherein the combined molecular weight of the two PEG chains is about 1,000 to about 5,000 Daltons.

Charged C-Terminus

The solubility of the Class 3 glucagon related peptide comprising SEQ ID NO: 20 can be further improved, for example, by introducing one, two, three or more charged amino acid(s) to the C-terminal portion of glucagon peptide of SEQ ID NO: 20, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. Additional modifications, e.g. conservative substitutions, may be made to the Class 3 glucagon related peptide that still allow it to retain glucagon activity. In some embodiments, an analog of the Class 3 glucagon related peptide of SEQ ID NO: 20 is provided wherein the analog differs from SEQ ID NO: 20 by 1 to 2 amino acid substitutions at positions 17-26, and, in some embodiments, the analog differs from the peptide of SEQ ID NO: 20 by an amino acid substitution at position 20.

Acylation/Alkylation

In accordance with some embodiments, the glucagon peptide is modified to comprise an acyl or alkyl group, e.g., a C4 to C30 acyl or alkyl group. In some aspects, the acyl group or alkyl group is not naturally occurring on an amino acid. In specific aspects, the acyl or alkyl group is non-native to any naturally-occurring amino acid. Acylation or alkylation can increase the half-life in circulation and/or delay the onset of and/or extend the duration of action and/or improve resistance to proteases such as DPP-IV. The activity at the glucagon receptor and GLP-1 receptor of the Class 3 glucagon related peptides is maintained, if not substantially enhanced after acylation Further, the potency of the acylated analogs were comparable to the unacylated versions of the Class 3 glucagon related peptides, if not substantially enhanced.

In some embodiments, the invention provides a Class 3 glucagon related peptide modified to comprise an acyl group or alkyl group covalently linked to the amino acid at position 10 of the glucagon peptide. The glucagon peptide may further comprise a spacer between the amino acid at position 10 of the Class 3 glucagon related peptide and the acyl group or alkyl group. Any of the foregoing Class 3 glucagon related peptides may comprise two acyl groups or two alkyl groups, or a combination thereof.

In a specific aspect of the invention, the acylated Class 3 glucagon related peptide comprises the amino acid sequence of any of SEQ ID NOs: 534-544 and 546-549.

C-Terminal Truncation

In some embodiments, the Class 3 glucagon related peptides described herein are further modified by truncation or deletion of one or two amino acids of the C-terminus of the glucagon peptide (i.e., position 29 and/or 28) without affecting activity and/or potency at the glucagon and GLP-1 receptors. In this regard, the Class 3 glucagon related peptide can comprise amino acids 1-27 or 1-28 of the native glucagon peptide (SEQ ID NO: 1), optionally with one or more modifications described herein.

In some embodiments, the truncated Class 3 glucagon related peptide comprises SEQ ID NO: 550 or SEQ ID NO: 551. In another embodiment, the truncated glucagon agonist peptide comprises SEQ ID NO: 552 or SEQ ID NO: 553.

C-Terminal Extension

In accordance with some embodiments, the Class 3 glucagon related peptides disclosed herein are modified by the addition of a second peptide to the carboxy terminus of the glucagon peptide, for example, SEQ ID NO: 26, SEQ ID NO: 27 or SEQ ID NO: 28. In some embodiments, a Class 3 glucagon related peptide having a sequence selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 66, SEQ ID NO: 67, SEQ ID NO: 68, and SEQ ID NO: 69 is covalently bound through a peptide bond to a second peptide, wherein the second peptide comprises a sequence selected from the group consisting of SEQ ID NO: 26, SEQ ID NO: 27 and SEQ ID NO: 28. In a further embodiment, in Class 3 glucagon related peptides which comprise the C-terminal extension, the threonine at position 29 of the native glucagon peptide is replaced with a glycine. A Class 3 glucagon related peptide having a glycine substitution for threonine at position 29 and comprising the carboxy terminal extension of SEQ ID NO: 26 is four times as potent at the GLP-1 receptor as native glucagon modified to comprise the carboxy terminal extension of SEQ ID NO: 26. Potency at the GLP-1 receptor can be further enhanced by an alanine substitution for the native arginine at position 18.

Accordingly, the Class 3 glucagon related peptide can have a carboxy terminal extension of SEQ ID NO: 27 (KRNRNNIA) or SEQ ID NO: 28. In accordance with some embodiments, Class 3 glucagon related peptide comprising SEQ ID NO: 33 or SEQ ID NO: 20, further comprises the amino acid sequence of SEQ ID NO: 27 (KRNRNNIA) or SEQ ID NO: 28 linked to amino acid 29 of the glucagon peptide. More particularly, the Class 3 glucagon related peptide comprises a sequence selected from the group consisting of SEQ ID NO: 10, SEQ ID NO: 12, SEQ ID NO: 13 SEQ ID NO: 14 and SEQ ID NO: 15, further comprising the amino acid sequence of SEQ ID NO: 27 (KRNRNNIA) or SEQ ID NO: 28 linked to amino acid 29 of the glucagon peptide. More particularly, the glucagon peptide comprises a sequence selected from the group consisting of SEQ ID NO: 10, SEQ ID NO: 12, SEQ ID NO: 13 SEQ ID NO: 14, SEQ ID NO: 15, SEQ ID NO: 16, SEQ ID NO: 17, SEQ ID NO: 18, SEQ ID NO: 66, SEQ ID NO: 67, SEQ ID NO: 68, SEQ ID NO: 69, SEQ ID NO: 55 and SEQ ID NO: 56 further comprising the amino acid sequence of SEQ ID NO: 26 (GPSSGAPPPS) or SEQ ID NO:

29 linked to amino acid 29 of the Class 3 glucagon related peptide. In some embodiments, the Class 3 glucagon related peptide comprises the sequence of SEQ ID NO: 64.

Other Modifications

Any of the modifications described above with regard to Class 3 glucagon related peptides which increase or decrease glucagon receptor activity and which increase GLP-1 receptor activity can be applied individually or in combination. Combinations of the modifications that increase GLP-1 receptor activity generally provide higher GLP-1 activity than any of such modifications taken alone. Any of the modifications described above can also be combined with other modifications described herein in reference to Class 3 glucagon related peptides that confer other desirable properties, such as increased solubility and/or stability and/or duration of action. Alternatively, any of the modifications described above can be combined with other modifications described herein in reference to Class 3 glucagon related peptides that do not substantially affect solubility or stability or activity. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, or at the C-terminal amino acid of the peptide.

(C) Increasing stability by modification of the aspartic acid at position 15, for example, by deletion or substitution with glutamic acid, homoglutamic acid, cysteic acid or homocysteic acid. Such modifications can reduce degradation or cleavage at a pH within the range of 5.5 to 8, especially in acidic or alkaline buffers, for example, retaining at least 75%, 80%, 90%, 95%, 96%, 97%, 98% or 99% of the original peptide after 24 hours at 25° C.

(D) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ser, Thr, Ala or Aib. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(E) Increasing resistance to dipeptidyl peptidase IV (DPP IV) cleavage by modification of the amino acid at position 1 or 2 with the DPP-IV resistant amino acids described herein and including modification of the amino acid at position 2 with N-methyl-alanine.

(F) Conservative or non-conservative substitutions, additions or deletions that do not affect activity, for example, conservative substitutions at one or more of positions 2, 5, 7, 10, 11, 12, 13, 14, 16, 17, 18, 19, 20, 21, 24, 27, 28 or 29; deletions at one or more of positions 27, 28 or 29; or a deletion of amino acid 29 optionally combined with a C-terminal amide or ester in place of the C-terminal carboxylic acid group;

(G) Adding C-terminal extensions as described herein;

(H) Increasing half-life in circulation and/or extending the duration of action and/or delaying the onset of action, for example, through acylation or alkylation of the glucagon peptide, as described herein;

(I) Homodimerization or heterodimerization as described herein.

Other modifications include substitution of His at position 1 with a large, aromatic amino acid (e.g., Tyr, Phe, Trp or amino-Phe); Ser at position 2 with Ala; substitution of Tyr at position 10 with Val or Phe; substitution of Lys at position 12 with Arg; substitution of Asp at position 15 with Glu; substitution of Ser at position 16 with Thr or Aib.

Class 3 glucagon related peptides with GLP-1 activity that contain a non-conservative substitution of His at position 1 with a large, aromatic amino acid (e.g., Tyr) can retain GLP-1 activity provided that the alpha-helix is stabilized via an intramolecular bridge, e.g., such as any of those described herein.

Conjugates and Fusions

The Class 3 glucagon related peptide can be linked, optionally via covalent bonding and optionally via a linker, to a conjugate moiety.

The Class 3 glucagon related peptide also can be part of a fusion peptide or protein wherein a second peptide or polypeptide has been fused to a terminus, e.g., the carboxy terminus of the Class 3 glucagon related peptide.

More particularly, the fusion Class 3 glucagon related peptide may comprise a glucagon agonist of SEQ ID NO: 55, SEQ ID NO: 9 or SEQ ID NO: 10 further comprising an amino acid sequence of SEQ ID NO: 26 (GPSSGAPPPS), SEQ ID NO: 27 (KRNRNNIA) or SEQ ID NO: 28 (KRNR) linked to amino acid 29 of the glucagon peptide. In some embodiments, the amino acid sequence of SEQ ID NO: 26 (GPSSGAPPPS), SEQ ID NO: 27 (KRNRNNIA) or SEQ ID NO: 28 (KRNR) is bound to amino acid 29 of the Class 3 glucagon related peptide through a peptide bond. Applicants have discovered that in Class 3 glucagon related peptide fusion peptides comprising the C-terminal extension peptide of Exendin-4 (e.g., SEQ ID NO: 26 or SEQ ID NO: 29), substitution of the native threonine residue at position 29 with glycine dramatically increases GLP-1 receptor activity. This amino acid substitution can be used in conjunction with other modifications disclosed herein with regard to Class 3 glucagon related peptides to enhance the affinity of the glucagon analogs for the GLP-1 receptor. For example, the T29G substitution can be combined with the S16E and N20K amino acid substitutions, optionally with a lactam bridge between amino acids 16 and 20, and optionally with addition of a PEG chain as described herein. In some embodiments, a Class 3 glucagon related peptide comprises the sequence of SEQ ID NO: 64. In some embodiments, the Class 3 glucagon related peptide portion of the glucagon fusion peptide is selected from the group consisting of SEQ ID NO: 55, SEQ ID NO: 2, SEQ ID NO: 3, SEQ ID NO: 4, and SEQ ID NO: 5 wherein a PEG chain, when present at positions 17, 21, 24, or the C-terminal amino acid, or at both 21 and 24, is selected from the range of 500 to 40,000 Daltons. More particularly, in some embodiments, the Class 3 glucagon related peptide segment is selected from the group consisting of SEQ ID NO: 7, SEQ ID NO: 8, and SEQ ID NO: 63, wherein the PEG chain is selected from the range of 500 to 5,000. In some embodiments, the Class 3 glucagon related peptide is a fusion peptide comprising the sequence of SEQ ID NO: 55 and SEQ ID NO: 65 wherein the peptide of SEQ ID NO: 65 is linked to the carboxy terminus of SEQ ID NO: 55.

In accordance with some embodiments, an additional chemical modification of the Class 3 glucagon related peptide of SEQ ID NO: 10 bestows increased GLP-1 receptor potency to a point where the relative activity at the glucagon and GLP-1 receptors is virtually equivalent. Accordingly, in some embodiments, a Class 3 glucagon related peptide comprises a terminal amino acid comprising an amide group in place of the carboxylic acid group that is present on the native amino acid. The relative activity of the Class 3 glucagon related peptide at the respective glucagon and GLP-1 receptors can be adjusted by further modifications to the Class 3 glucagon related peptide to produce analogs demonstrating about 40% to about 500% or more of the activity of native glucagon at the glucagon receptor and about 20% to about 200% or more of the activity of native GLP-1 at the GLP-1 receptor, e.g. 50-fold, 100-fold or more increase relative to the normal activity of glucagon at the GLP-1 receptor. In some embodiments, the glucagon peptides described herein exhibit up to about 100%, 1000%, 10,000%, 100,000%, or 1,000,000% of the activity of native glucagon at the glucagon receptor. In some embodiments, the glucagon peptides described herein exhibit up to about 100%, 1000%, 10,000%, 100,000%, or 1,000,000% of the activity of native GLP-1 at the GLP-1 receptor.

Exemplary Embodiments

In accordance with some embodiments, a glucagon analog is provided comprising the sequence of SEQ ID NO: 55, wherein said analog differs from SEQ ID NO: 55 by 1 to 3 amino acids, selected from positions 1, 2, 3, 5, 7, 10, 11, 13, 14, 17, 18, 19, 21, 24, 27, 28, and 29, wherein said glucagon peptide exhibits at least 20% of the activity of native GLP-1 at the GLP-1 receptor.

In accordance with some embodiments a glucagon/GLP-1 receptor co-agonist is provided comprising the sequence:
NH$_2$-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 33) wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH or CONH$_2$, with the proviso that when position 16 is serine, position 20 is Lys, or alternatively when position 16 is serine the position 24 is Glu and either position 20 or position 28 is Lys. In some embodiments the glucagon/GLP-1 receptor co-agonist comprises the sequence of SEQ ID NO: 33 wherein the amino acid at position 28 is aspartic acid and the amino acid at position 29 is glutamic acid. In another embodiment the amino acid at position 28 is the native asparagine, the amino acid at position 29 is glycine and the amino acid sequence of SEQ ID NO: 29 or SEQ ID NO: 65 is covalently linked to the carboxy terminus of SEQ ID NO: 33.

In some embodiments a co-agonist is provided comprising the sequence of SEQ ID NO: 33 wherein an additional acidic amino acid added to the carboxy terminus of the peptide. In a further embodiment the carboxy terminal amino acid of the glucagon analog has an amide in place of the carboxylic acid group of the natural amino acid. In some embodiments the glucagon analog comprises a sequence selected from the group consisting of SEQ ID NO: 40, SEQ ID NO: 41, SEQ ID NO: 42, SEQ ID NO: 43 and SEQ ID NO: 44.

In accordance with some embodiments a glucagon peptide analog of SEQ ID NO: 33 is provided, wherein said analog differs from SEQ ID NO: 33 by 1 to 3 amino acids, selected from positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28. In accordance with some embodiments the analog differs from SEQ ID NO: 33 by 1 to 3 amino acids selected from positions 1, 2, 3, 21 and 27. In some embodiments the glucagon peptide analog of SEQ ID NO: 33 differs from that sequence by 1 to 2 amino acids, or in some embodiments by a single amino acid, selected form positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28.

In accordance with another embodiment a relatively selective GLP-1 receptor agonist is provided comprising the sequence NH$_2$-His-Ser-Xaa-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 53) wherein the Xaa at position 3 is selected from the group of amino acids consisting of Glu, Orn or Nle, the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH, CONH2, SEQ ID NO: 26 or SEQ ID NO: 29, with the proviso that when position 16 is serine, position 20 is Lys, or alternatively when position 16 is serine the position 24 is Glu and either position 20 or position 28 is Lys. In some embodiments the amino acid at position 3 is glutamic acid. In some embodiments the acidic amino acid substituted at position 28 and/or 29 is aspartic acid or glutamic acid. In some embodiments the glucagon peptide, including a co-agonist peptide, comprises the sequence of SEQ ID NO: 33 further comprising an additional acidic amino acid added to the carboxy terminus of the peptide. In a further embodiment the carboxy terminal amino acid of the glucagon analog has an amide in place of the carboxylic acid group of the natural amino acid.

In accordance with some embodiments a glucagon/GLP-1 receptor co-agonist is provided comprising a modified glucagon peptide selected from the group consisting of:
NH$_2$-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 34), wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu and the Xaa at position 28 is Asn, Asp or Lys, R is COOH or CONH$_2$, the Xaa at position 29 is Thr or Gly, and R is COOH, CONH$_2$, SEQ ID NO: 26 or SEQ ID NO: 29, with the proviso that when position 16 is serine, position 20 is Lys, or alternatively when position 16 is serine the position 24 is Glu and either position 20 or position 28 is Lys. In some embodiments R is CONH$_2$, the Xaa at position 15 is Asp, the Xaa at position 16 is selected from the group of amino acids consisting of Glu, Gln, homoglutamic acid and homocysteic acid, the Xaas at positions 20 and 24 are each Gln the Xaa at position 28 is Asn or Asp and the Xaa at position 29 is Thr. In some embodiments the Xaas at positions 15 and 16 are each Glu, the Xaas at positions 20 and 24 are each Gln, the Xaa at position 28 is Asn or Asp, the Xaa at position 29 is Thr and R is CONH$_2$.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 17, 18, 19, 20, 21, 24, 27, 28 or 29 of the peptide of SEQ ID NO: 11 can be substituted with an amino acid different from that present in the native glucagon peptide, and still retain activity at the glucagon receptor. In some embodiments the methionine residue present at position 27 of the native peptide is changed to leucine or norleucine to prevent oxidative degradation of the peptide. In another embodiment the amino acid at position 20 is substituted with Lys, Arg, Orn or Citrullene and/or position 21 is substituted with Glu, homoglutamic acid or homocysteic acid.

In some embodiments a glucagon analog of SEQ ID NO: 20 is provided wherein 1 to 6 amino acids, selected from positions 1, 2, 5, 7, 10, 11, 13, 14, 17, 18, 19, 21, 27, 28 or 29 of the analog differ from the corresponding amino acid of SEQ ID NO: 1, with the proviso that when the amino acid at position 16 is serine, position 20 is Lys, or alternatively when position 16 is serine the position 24 is Glu and either position 20 or position 28 is Lys. In accordance with another embodiment a glucagon analog of SEQ ID NO: 20 is provided wherein 1 to 3 amino acids selected from positions 1, 2, 5, 7, 10, 11, 13, 14, 17, 18, 19, 20, 21, 27, 28 or 29 of the analog differ from the corresponding amino acid of SEQ ID NO: 1. In another embodiment, a glucagon analog of SEQ ID NO: 8, SEQ ID NO: 9 or SEQ ID NO: 11 is provided wherein 1 to 2 amino acids selected from positions 1, 2, 5, 7, 10, 11, 13, 14, 17, 18, 19, 20 or 21 of the analog differ from the corresponding amino acid of SEQ ID NO: 1, and in a further embodiment the one to two differing amino acids represent conservative amino acid substitutions relative to the amino acid present in the native glucagon sequence (SEQ ID NO: 1). In some embodiments a glucagon peptide of SEQ ID NO: 12, SEQ ID NO: 13, SEQ ID NO: 14 or SEQ ID NO: 15 is provided wherein the glucagon peptide further comprises one, two or three amino acid substitutions at positions selected from positions 2, 5, 7, 10, 11, 13, 14, 17, 18, 19, 20, 21, 27 or 29. In some embodiments the substitutions at positions 2, 5, 7, 10, 11, 13, 14, 16, 17, 18, 19, 20, 21, 27 or 29 are conservative amino acid substitutions.

In accordance with some embodiments a glucagon/GLP-1 receptor co-agonist is provided comprising a variant of the sequence of SEQ ID NO 33, wherein 1 to 10 amino acids selected from positions 16, 17, 18, 20, 21, 23, 24, 27, 28 and 29, respectively, of the variant differ from the corresponding amino acid of SEQ ID NO: 1. In accordance with some embodiments a variant of the sequence of SEQ ID NO 33 is provided wherein the variant differs from SEQ ID NO: 33 by one or more amino acid substitutions selected from the group consisting of Gln17, Ala18, Glu21, Ile23, Ala24, Val27 and Gly29. In accordance with some embodiments a glucagon/GLP-1 receptor co-agonist is provided comprising variants of the sequence of SEQ ID NO 33, wherein 1 to 2 amino acids selected from positions 17-26 of the variant differ from the corresponding amino acid of SEQ ID NO: 1. In accordance with some embodiments a variant of the sequence of SEQ ID NO 33 is provided wherein the variant differs from SEQ ID NO: 33 by an amino acid substitution selected from the group consisting of Gln17, Ala18, Glu21, Ile23 and Ala24. In accordance with some embodiments a variant of the sequence of SEQ ID NO 33 is provided wherein the variant differs from SEQ ID NO: 33 by an amino acid substitution at position 18 wherein the substituted amino acid is selected from the group consisting of Ala, Ser, Thr, and Gly. In accordance with some embodiments a variant of the sequence of SEQ ID NO 33 is provided wherein the variant differs from SEQ ID NO: 33 by an amino acid substitution of Ala at position 18. Such variations are encompassed by SEQ ID NO: 55. In another embodiment a glucagon/GLP-1 receptor co-agonist is provided comprising variants of the sequence of SEQ ID NO 33, wherein 1 to 2 amino acids selected from positions 17-22 of the variant differ from the corresponding amino acid of SEQ ID NO: 1, and in a further embodiment a variant of SEQ ID NO 33 is provided wherein the variant differs from SEQ ID NO: 33 by for 2 amino acid substitutions at positions 20 and 21. In accordance with some embodiments a glucagon/GLP-1 receptor co-agonist is provided comprising the sequence:

NH$_2$-His-Ser-Gln-Gly-Thr-Phe-Thr-Ser-Asp-Tyr-Ser-Lys-Tyr-Leu-Xaa-Xaa-Arg-Arg-Ala-Xaa-Xaa-Phe-Val-Xaa-Trp-Leu-Met-Xaa-Xaa-R (SEQ ID NO: 51), wherein the Xaa at position 15 is Asp, Glu, cysteic acid, homoglutamic acid or homocysteic acid, the Xaa at position 16 is Ser, Glu, Gln, homoglutamic acid or homocysteic acid, the Xaa at position 20 is Gln, Lys, Arg, Orn or citrulline, the Xaa at position 21 is Asp, Glu, homoglutamic acid or homocysteic acid, the Xaa at position 24 is Gln or Glu, the Xaa at position 28 is Asn, Lys or an acidic amino acid, the Xaa at position 29 is Thr or an acid amino acid and R is COOH or CONH2. In some embodiments R is CONH2. In accordance with some embodiments a glucagon/GLP-1 receptor co-agonist is provided comprising a variant of SEQ ID NO: 11, SEQ ID NO: 12, SEQ ID NO: 13, SEQ ID NO: 14, SEQ ID NO: 15, SEQ ID NO: 47, SEQ ID NO: 48 or SEQ ID NO: 49, wherein the variant differs from said sequence by an amino acid substitution at position 20. In some embodiments the amino acid substitution is selected form the group consisting of Lys, Arg, Orn or citrulline for position 20.

In some embodiments a glucagon agonist is provided comprising an analog peptide of SEQ ID NO: 34 wherein the analog differs from SEQ ID NO: 34 by having an amino acid other than serine at position 2. In some embodiments the serine residue is substituted with aminoisobutyric acid, D-alanine, and in some embodiments the serine residue is substituted with aminoisobutyric acid. Such modifications suppresses cleavage by dipeptidyl peptidase IV while retaining the inherent potency of the parent compound (e.g. at least 75, 80, 85, 90, 95% or more of the potency of the parent compound). In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 34.

In some embodiments the glucagon analogs disclosed herein are further modified at position 1 or 2 to reduce susceptibility to cleavage by dipeptidyl peptidase IV. In some embodiments a glucagon analog of SEQ ID NO: 9, SEQ ID NO: 11, SEQ ID NO: 12, SEQ ID NO: 13, SEQ ID NO: 14 or SEQ ID NO: 15 is provided wherein the analog differs from the parent molecule by a substitution at position 2 and exhibits reduced susceptibility (i.e., resistance) to cleavage by dipeptidyl peptidase IV. More particularly, in some embodiments position 2 of the analog peptide is substituted with an amino acid selected from the group consisting of D-serine, D-alanine, valine, amino n-butyric acid, glycine, N-methyl serine and aminoisobutyric acid. In some embodiments position 2 of the analog peptide is substituted with an amino acid selected from the group consisting of D-serine, D-alanine, glycine, N-methyl serine and aminoisobutyric acid. In another embodiment position 2 of the analog peptide is substituted with an amino acid selected from the group consisting of D-serine, glycine, N-methyl serine and aminoisobutyric acid. In some embodiments the amino acid at position 2 is not D-serine. In some embodiments the glucagon peptide comprises the sequence of SEQ ID NO: 21 or SEQ ID NO: 22.

In some embodiments a glucagon analog of SEQ ID NO: 9, SEQ ID NO: 11, SEQ ID NO: 12, SEQ ID NO: 13, SEQ ID NO: 14 or SEQ ID NO: 15 is provided wherein the analog differs from the parent molecule by a substitution at position 1 and exhibits reduced susceptibility (i.e., resistance) to cleavage by dipeptidyl peptidase IV. More particularly, position 1 of the analog peptide is substituted with an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. In another embodiment a glucagon agonist is provided comprising an analog peptide of SEQ ID NO: 34 wherein the analog differs from SEQ ID NO: 34 by having an amino acid other than histidine at position 1. In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 34. In some embodiments the acidic amino acid is aspartic acid or glutamic acid.

In some embodiments the glucagon/GLP-1 receptor co-agonist comprises a sequence of SEQ ID NO: 20 further comprising an additional carboxy terminal extension of one amino acid or a peptide selected from the group consisting of SEQ ID NO: 26, SEQ ID NO: 27 and SEQ ID NO: 28. In the embodiment wherein a single amino acid is added to the carboxy terminus of SEQ ID NO: 20, the amino acid is typically selected from one of the 20 common amino acids, and in some embodiments the additional carboxy terminus amino acid has an amide group in place of the carboxylic acid of the native amino acid. In some embodiments the additional amino acid is selected from the group consisting of glutamic acid, aspartic acid and glycine.

In an alternative embodiment a glucagon/GLP-1 receptor co-agonist is provided wherein the peptide comprises at least one lactam ring formed between the side chain of a glutamic acid residue and a lysine residue, wherein the glutamic acid residue and a lysine residue are separated by three amino acids. In some embodiments the carboxy terminal amino acid of the lactam bearing glucagon peptide has an amide group in place of the carboxylic acid of the native amino acid. More particularly, in some embodiments a glucagon and GLP-1 co-agonist is provided comprising a modified glucagon peptide selected from the group consisting of:

```
                                              (SEQ ID NO: 66)
NH2-His-Ser-Gln-Gly-Thr-Phe-Thr-Ser-Asp-Tyr-Ser-

Lys-Tyr-Leu-Asp-Glu-Arg-Arg-Ala-Gln-Asp-Phe-Val-

Gln-Trp-Leu-Met-Xaa-Xaa-R (SEQ ID NO: 67)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Gln-Trp-Leu-Met-Xaa-Xaa-R (SEQ ID NO: 68)
NH2-His-Ser-Gln-Gly-Thr-Phe-Thr-Ser-Asp-Tyr-Ser-

Lys-Tyr-Leu-Asp-Ser-Arg-Arg-Ala-Lys-Asp-Phe-Val-

Glu-Trp-Leu-Met-Xaa-Xaa-R (SEQ ID NO: 69)
NH2-His-Ser-Gln-Gly-Thr-Phe-Thr-Ser-Asp-Tyr-Ser-

Lys-Tyr-Leu-Asp-Ser-Arg-Arg-Ala-Gln-Asp-Phe-Val-

Glu-Trp-Leu-Met-Lys-Xaa-R (SEQ ID NO: 16)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Glu-Trp-Leu-Met-Asn-Thr-R (SEQ ID NO: 17)
NH2-His-Ser-Gln-Gly-Thr-Phe-Thr-Ser-Asp-Tyr-Ser-

Lys-Tyr-Leu-Asp-Glu-Arg-Arg-Ala-Gln-Asp-Phe-Val-

Glu-Trp-Leu-Met-Lys-Thr-R (SEQ ID NO: 18)
NH2-His-Ser-Gln-Gly-Thr-Phe-Thr-Ser-Asp-Tyr-Ser-

Lys-Tyr-Leu-Asp-Glu-Arg-Arg-Ala-Lys-Asp-Phe-Val-

Glu-Trp-Leu-Met-Lys-Thr-R
``` wherein Xaa at position 28 is Asp, or Asn, the Xaa at position 29 is Thr or Gly, R is selected from the group consisting of COOH, CONH$_2$, glutamic acid, aspartic acid, glycine, SEQ ID NO: 26, SEQ ID NO: 27 and SEQ ID NO: 28, and a lactam bridge is formed between Lys at position 12 and Glu at position 16 for SEQ ID NO: 66, between Glu at position 16 and Lys at position 20 for SEQ ID NO: 67, between Lys at position 20 and Glu at position 24 for SEQ ID NO: 68, between Glu at position 24 and Lys at position 28 for SEQ ID NO: 69, between Lys at position 12 and Glu at position 16 and between Lys at position 20 and Glu at position 24 for SEQ ID NO: 16, between Lys at position 12 and Glu at position 16 and between Glu at position 24 and Lys at position 28 for SEQ ID NO: 17 and between Glu at position 16 and Lys at position 20 and between Glu at position 24 and Lys at position 28 for SEQ ID NO: 18. In some embodiments R is selected from the group consisting of COOH, CONH$_2$, glutamic acid, aspartic acid, glycine, the amino acid at position 28 is Asn, and the amino acid at position 29 is threonine. In some embodiments R is CONH$_2$, the amino acid at position 28 is Asn and the amino acid at position 29 is threonine. In another embodiment R is selected from the group consisting of SEQ ID NO: 26, SEQ ID NO: 29 and SEQ ID NO: 65 and the amino acid at position 29 is glycine.

In a further embodiment the glucagon/GLP-1 receptor co-agonist is selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17 and SEQ ID NO: 18, wherein the peptide further comprises an additional carboxy terminal extension of one amino acid or a peptide selected from the group consisting of SEQ ID NO: 26, SEQ ID NO: 27 and SEQ ID NO: 28. In some embodiments the terminal extension comprises the sequence of SEQ ID NO: 26, SEQ ID NO: 29 or SEQ ID NO: 65 and the glucagon peptide comprises the sequence of SEQ ID NO: 55. In some embodiments the glucagon/GLP-1 receptor co-agonist comprises the sequence of SEQ ID NO: 33 wherein the amino acid at position 16 is glutamic acid, the amino acid at position 20 is lysine, the amino acid at position 28 is asparagine and the amino acid sequence of SEQ ID No: 26 or SEQ ID NO: 29 is linked to the carboxy terminus of SEQ ID NO: 33.

In the embodiment wherein a single amino acid is added to the carboxy terminus of SEQ ID NO: 20, the amino acid is typically selected from one of the 20 common amino acids, and in some embodiments the amino acid has an amide group in place of the carboxylic acid of the native amino acid. In some embodiments the additional amino acid is selected from the group consisting of glutamic acid and aspartic acid and glycine. In the embodiments wherein the glucagon agonist analog further comprises a carboxy terminal extension, the carboxy terminal amino acid of the extension, in some embodiments, ends in an amide group or an ester group rather than a carboxylic acid.

In another embodiment the glucagon/GLP-1 receptor co-agonist comprises the sequence: NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-Xaa-CONH$_2$ (SEQ ID NO: 19), wherein the Xaa at position 30 represents any amino acid. In some embodiments Xaa is selected from one of the 20 common amino acids, and in some embodiments the amino acid is glutamic acid, aspartic acid or glycine. The solubility of this peptide can be further improved by covalently linking a PEG chain to the side chain of amino acid at position 17, 21, 24 or 30 of SEQ ID NO: 19. In a further embodiment the peptide comprises an additional carboxy terminal extension of a peptide selected from the group consisting of SEQ ID NO: 26, SEQ ID NO: 27 and SEQ ID NO: 28. In accordance with some embodiments the glucagon/GLP-1 receptor co-agonist comprises the sequence of SEQ ID NO: 30, SEQ ID NO: 31 and SEQ ID NO: 32.

Additional site specific modifications internal to the glucagon sequence of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19 and SEQ ID NO: 64 can be made to yield a set of glucagon agonists that possess variable degrees of GLP-1 agonism. Accordingly, peptides that possess virtually identical in vitro potency at each receptor have been prepared and characterized. Similarly, peptides with tenfold selectively enhanced potency at each of the two receptors have been identified and characterized. As noted above substitution of the serine residue at position 16 with glutamic acid enhances the potency of native glucagon at both the Glucagon and GLP-1 receptors, but maintains approximately a tenfold selectivity for the glucagon receptor. In addition by substituting the native glutamine at position 3 with glutamic acid (SEQ ID NO: 22) generates a glucagon analog that exhibits approximately a tenfold selectivity for the GLP-1 receptor.

The solubility of the glucagon/GLP-1 co-agonist peptides can be further enhanced in aqueous solutions at physiological pH, while retaining the high biological activity relative to native glucagon by the introduction of hydrophilic groups at positions 16, 17, 21, and 24 of the peptide, or by the addition of a single modified amino acid (i.e., an amino acid modified to comprise a hydrophilic group) at the carboxy terminus of the glucagon/GLP-1 co-agonist peptide. In accordance with some embodiments the hydrophilic group comprises a polyethylene (PEG) chain. More particularly, in some embodiments the glucagon peptide comprises the sequence of SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17 or SEQ ID NO: 18 wherein a PEG chain is covalently linked to the side chain of an amino acids at position 16, 17, 21, 24, 29 or the C-terminal amino acid of the glucagon peptide, with the proviso that when the peptide comprises SEQ ID NO: 10, SEQ ID NO: 11, SEQ ID NO: 12 or SEQ ID NO: 13 the polyethylene glycol chain is covalently bound to an amino acid residue at position 17, 21 or 24, when the peptide comprises SEQ ID NO: 14 or SEQ ID NO: 15 the polyethylene glycol chain is covalently bound to an amino acid residue at position 16, 17 or 21, and when the peptide comprises SEQ ID NO: 16, SEQ ID NO: 17 or SEQ ID NO: 18 the polyethylene glycol chain is covalently bound to an amino acid residue at position 17 or 21.

In some embodiments the glucagon peptide comprises the sequence of SEQ ID NO: 11, SEQ ID NO: 12 or SEQ ID NO: 13, wherein a PEG chain is covalently linked to the side chain of an amino acids at position 17, 21, 24, or the C-terminal amino acid of the glucagon peptide, and the carboxy terminal amino acid of the peptide has an amide group in place of the carboxylic acid group of the native amino acid. In some embodiments the glucagon/GLP-1 receptor co-agonist peptide comprises a sequence selected from the group consisting of SEQ ID NO: 12, SEQ ID NO: 13, SEQ ID NO: 14, SEQ ID NO: 15, SEQ ID NO: 16, SEQ ID NO: 17, SEQ ID NO: 18 and SEQ ID NO: 19, wherein a PEG chain is covalently linked to the side chain of an amino acid at position 17, 21 or 24 of SEQ ID NO: 12, SEQ ID NO: 13 and SEQ ID NO: 19, or at position 16, 17 or 21 of SEQ ID NO: 14 and SEQ ID NO: 15 or at position 17 or 21 of SEQ ID NO: 16, SEQ ID NO: 17 and SEQ ID NO: 18 of the glucagon peptide. In another embodiment the glucagon/GLP-1 receptor co-agonist peptide comprises the sequence of SEQ ID NO: 11 or SEQ ID NO: 19, wherein a PEG chain is covalently linked to the side chain of an amino acids at position 17, 21 or 24 or the C-terminal amino acid of the glucagon peptide.

In accordance with some embodiments, and subject to the proviso limitations described in the preceding paragraphs, the glucagon co-agonist peptide is modified to contain one or more amino acid substitution at positions 16, 17, 21, 24, or 29 or the C-terminal amino acid, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. Alternatively, the amino acid having a side chain suitable for crosslinking with hydrophilic moieties, including for example, PEG, can be added to the carboxy terminus of any of the glucagon analogs disclosed herein. In accordance with some embodiments an amino acid substitution is made in the glucagon/GLP-1 receptor co-agonist peptide at a position selected from the group consisting of 16, 17, 21, 24, or 29 replacing the native amino acid with an amino acid selected from the group consisting of lysine, cysteine, ornithine, homocysteine and acetyl phenylalanine, wherein the substituting amino acid further comprises a PEG chain covalently bound to the side chain of the amino acid. In some embodiments a glucagon peptide selected form the group consisting of SEQ ID NO: 12, SEQ ID NO: 13, SEQ ID NO: 14, SEQ ID NO: 15, SEQ ID NO: 16, SEQ ID NO: 17, SEQ ID NO: 18, and SEQ ID NO: 19 is further modified to comprise a PEG chain is covalently linked to the side chain of an amino acid at position 17 or 21 of the glucagon peptide. In some embodiments the pegylated glucagon/GLP-1 receptor co-agonist further comprises the sequence of SEQ ID NO: 26, SEQ ID NO: 27 or SEQ ID NO: 29.

In another embodiment the glucagon peptide comprises the sequence of SEQ ID NO: 55 or SEQ ID NO: 56, further comprising a C-terminal extension of SEQ ID NO: 26, SEQ ID NO: 29 or SEQ ID NO: 65 linked to the C-terminal amino acid of SEQ ID NO: 55 or SEQ ID NO: 56, and optionally further comprising a PEG chain covalently linked to the side chain of an amino acids at position 17, 18, 21, 24 or 29 or the C-terminal amino acid of the peptide. In another embodiment the glucagon peptide comprises the sequence of SEQ ID NO: 55 or SEQ ID NO: 56, wherein a PEG chain is covalently linked to the side chain of an amino acids at position 21 or 24 of the glucagon peptide and the peptide further comprises a C-terminal extension of SEQ ID NO: 26, or SEQ ID NO: 29.

In another embodiment the glucagon peptide comprises the sequence of SEQ ID NO: 55, or SEQ ID NO: 33 or SEQ ID NO: 34, wherein an additional amino acid is added to the carboxy terminus of SEQ ID NO: 33 or SEQ ID NO: 34, and a PEG chain is covalently linked to the side chain of the added amino acid. In a further embodiment, the pegylated glucagon analog further comprises a C-terminal extension of SEQ ID NO: 26 or SEQ ID NO: 29 linked to the C-terminal amino acid of SEQ ID NO: 33 or SEQ ID NO: 34. In another embodiment the glucagon peptide comprises the sequence of SEQ ID NO: 19, wherein a PEG chain is covalently linked to the side chain of the amino acid at position 30 of the glucagon peptide and the peptide further comprises a C-terminal extension of SEQ ID NO: 26 or SEQ ID NO: 29 linked to the C-terminal amino acid of SEQ ID NO: 19.

The polyethylene glycol chain may be in the form of a straight chain or it may be branched. In accordance with some embodiments the polyethylene glycol chain has an average molecular weight selected from the range of about 500 to about 10,000 Daltons. In some embodiments the polyethylene glycol chain has an average molecular weight selected from the range of about 1,000 to about 5,000 Daltons. In an alternative embodiment the polyethylene glycol chain has an average molecular weight selected from the range of about 10,000 to about 20,000 Daltons. In accordance with some embodiments the pegylated glucagon peptide comprises two or more polyethylene glycol chains covalently bound to the glucagon peptide wherein the total molecular weight of the glucagon chains is about 1,000 to about 5,000 Daltons. In some embodiments the pegylated glucagon agonist comprises a peptide consisting of SEQ ID NO: 5 or a glucagon agonist analog of SEQ ID NO: 5, wherein a PEG chain is covalently linked to the amino acid residue at position 21 and at position 24, and wherein the combined molecular weight of the two PEG chains is about 1,000 to about 5,000 Daltons.

In certain exemplary embodiments, the glucagon peptide comprises the amino acid sequence of SEQ ID NO: 1 with up to ten amino acid modifications and comprises an amino acid at position 10 which is acylated or alkylated. In some embodiments, the amino acid at position 10 is acylated or alkylated with a C4 to C30 fatty acid. In certain aspects, the amino acid at position 10 comprises an acyl group or an alkyl group which is non-native to a naturally-occurring amino acid.

In certain embodiments, the glucagon peptide comprising an amino acid at position 10 which is acylated or alkylated comprises a stabilized alpha helix. Accordingly, in certain aspects, the glucagon peptide comprises an acyl or alkyl group as described herein and an intramolecular bridge, e.g., a covalent intramolecular bridge (e.g., a lactam bridge) between the side chains of an amino acid at position i and an amino acid at position i+4, wherein i is 12, 16, 20, or 24. Alternatively or additionally, the glucagon peptide comprises an acyl or alkyl group as described herein and one, two, three or more of positions 16, 20, 21 and/or 24 of the glucagon peptide are substituted with an α,α-disubstituted amino acid, e.g., Aib. In some instances, the non-native glucagon peptide comprises Glu at position 16 and Lys at position 20, wherein optionally a lactam bridge lnkes the Glu and the Lys, and, optionally, the glucagon peptide further comprises one or more modifications selected from the group consisting of: Gln at position 17, Ala at position 18, Glu at position 21, Ile at position 23, and Ala at position 24.

Also, in any of the embodiments, wherein the glucagon peptide comprises an amino acid at position 10 which is acylated or alkylated, the glucagon peptide can further comprise a C-terminal amide in lieu of the C-terminal alpha carboxylate.

In some embodiments, the glucagon peptide comprising an acyl or alkyl group as described herein further comprises an amino acid substitution at position 1, at position 2, or at positions 1 and 2, wherein the amino acid substitution(s) achieve DPP-IV protease resistance. For example, the His at position 1 may be substituted with an amino acid selected from the group consisting of: D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. Alternatively or additionally, the Ser at position 2 may be substituted with an amino acid selected from the group consisting of: D-serine, alanine, D-alanine, valine, glycine, N-methyl serine, N-methyl alanine, and amino isobutyric acid. In some embodiments the amino acid at position 2 is not D-serine.

The glucagon peptide comprising the amino acid at position 10 which is acylated or alkylated as described herein can comprise any amino acid sequence which is substantially related to SEQ ID NO: 1. For instance, the glucagon peptide comprises SEQ ID NO: 1 with up to 10 amino acid modifications (e.g., 0, 1, 2, 3, 4, 5, 6, 7, 8, 9, 10 modifications). In certain embodiments, the amino acid sequence of the acylated or alkylated glucagon peptide is greater than 25% identical to SEQ ID NO: 1 (e.g., greater than 30%, 35%, 40%, 50%, 60%, 70% 75%, 80%, 85%, 90%, 95%, 96%, 97%, 98%, 99%, or nearly 100% identical to SEQ ID NO: 1). In certain specific embodiments, the glucagon peptide is one which comprises SEQ ID NOs: 55 with an amino acid at position 10 acylated or alkylated as described herein. The glucagon peptide can be any of SEQ ID NOs: 55, 55 with 1 or 2 amino acid modifications, 2-4, 9-18, 20, 23-25, 33, 40-44, 53, 56, 61, 62, 64, 66-514, and 534.

The acyl or alkyl group of these embodiments may be any acyl or alkyl group described herein. For example, the acyl group may be a C4 to C30 (e.g., C8 to C24) fatty acyl group and the alkyl group may be a C4 to C30 (e.g., C8 to C24) alkyl group.

The amino acid to which the acyl or alkyl group is attached may be any of the amino acids described herein, e.g., an amino acid of any of Formula I (e.g., Lys), Formula II, and Formula III.

In some embodiments, the acyl group or alkyl group is directly attached to the amino acid at position 10. In some embodiments, the acyl or alkyl group is attached to the amino acid at position 10 via a spacer, such as, for example, a spacer which is 3 to 10 atoms in length, e.g., an amino acid or dipeptide. Suitable spacers for purposes of attaching an acyl or alkyl group are described herein.

In accordance with some embodiments, the Class 3 glucagon related peptide may be an analog of any of the foregoing Class 3 glucagon related peptides as described herein, which analog exhibits agonist activity at the GIP receptor. The activity level of the analog at the glucagon receptor, the GLP-1 receptor, and the GIP receptor, the potency at each of these receptors, and the selectivity for each of these receptors may be in accordance with the teachings of Class 2 glucagon related peptides described herein. See, the teachings under the subsection of the Class 2 glucagon related peptide section entitled "Activity."

In some embodiments of the invention, an analog of a glucagon peptide, which analog exhibits agonist activity at the GIP receptor, is provided. The analog in certain embodiments comprises the amino acid sequence of SEQ ID NO: 1 with at least one amino acid modification (optionally, up to 15 amino acid modifications), and an extension of 1 to 21 amino acids C-terminal to the amino acid at position 29 of the analog.

In certain aspects, the analogs comprise at least one amino acid modification and up to 15 amino acid modifications (e.g., 1, 2, 3, 4, 5, 6, 7, 8, 9, 10, 11, 12, 13, 14, 15 amino acid modifications, up to 10 amino acid modifications). In certain embodiments, the analogs comprise at least one amino acid modification at up to 10 amino acid modifications and additional conservative amino acid modifications. Conservative amino acid modifications are described herein.

In some aspects, at least one of the amino acid modifications confers a stabilized alpha helix structure in the C-terminal portion of the analog. Modifications which achieve a stabilized alpha helix structure are described herein. See, for example, the teachings under the section entitled Stabilization of the alpha helix/Intramolecular bridges. In some aspects, the analog comprises an intramolecular bridge (e.g., a covalent intramolecular bridge, a non-covalent intramolecular bridge) between the side chains of two amino acids of the analog. In certain aspects, an intramolecular bridge links the side chains of the amino acids at positions i and i+4, wherein i is 12, 13, 16, 17, 20, or 24. In other aspects, an intramolecular bridge connects the side chains of the amino acids at positions j and j+3, wherein j is 17, or at positions k and k+7" wherein k is any integer between 12 and 22. In certain embodiments, the intramolecular bridge is a covalent intramolecular bridge, e.g., a lactam bridge. In specific aspects, the lactam bridge connects the side chains of the amino acids at positions 16 and 20. In particular aspects, one of the amino acids at positions 16 and 20 is a positive-charged amino acid and the other is a negative-charged amino acid. For example, the analog can comprise a lactam bridge connecting the side chains of a Glu at position 16 and a Lys at position 20. In other aspects, the negative-charged amino acid and the positive-charged amino acid form a salt bridge. In this instance, the intramolecular bridge is a non-covalent intramolecular bridge.

In particular aspects, the amino acid modification which confers a stabilized alpha helix is an insertion or substitution of an amino acid of SEQ ID NO: 1 with an α,α-disubstituted amino acid. Suitable α,α-disubstituted amino acids for purposes of stabilizing the alpha helix are described herein and include, for example, Aib. In some aspects, one, two, three, or more of the amino acids at positions 16, 20, 21, and 24 of SEQ ID NO: 1 are substituted with an α,α-disubstituted amino acid, e.g., Aib. In particular embodiments, the amino acid at position 16 is Aib.

The analog which exhibits agonist activity at the GIP receptor can comprise additional modifications, such as any of those described herein. For instance, the amino acid modifications may increase or decrease activity at one or both of the GLP-1 receptor and glucagon receptor. The amino acid modifications may increase stability of the peptide, e.g., increase resistance to DPP-IV protease degradation, stabilize the bond between amino acids 15 and 16. The amino acid modifications may increase the solubility of the peptide and/or alter the time of action of the analog at any of the GIP, glucagon, and GLP-1 receptors. A combination of any of these types of modifications may be present in the analogs which exhibit agonist activity at the GIP receptor.

Accordingly, in some aspects, the analog comprises the amino acid sequence of SEQ ID NO: 1 with one or more of: Gln at position 17, Ala at position 18, Glu at position 21, Ile at position 23, and Ala or Cys at position 24, or conservative amino acid substitutions thereof. In some aspects, the analog comprises a C-terminal amide in place of the C-terminal alpha carboxylate. In certain embodiments, the analog comprises an amino acid substitution at position 1, position 2, or positions 1 and 2, which substitution(s) achieve DPP-IV protease resistance. Suitable amino acid substitutions are described herein. For example, DMIA at position 1 and/or d-Ser or Aib at position 2. In some embodiments, the amino acid at position 2 is not D-serine.

Additionally or alternatively, the analog may comprise one or a combination of: (a) Ser at position 2 substituted with Ala; (b) Gln at position 3 substituted with Glu or a glutamine analog; (c) Thr at position 7 substituted with a Ile; (d) Tyr at position 10 substituted with Trp or an amino acid comprising an acyl or alkyl group which is non-native to a naturally-occurring amino acid; (e) Lys at position 12 substituted with Ile; (f) Asp at position 15 substituted with Glu; (g) Ser at position 16 substituted with Glu; (h) Gln at position 20 substituted with Ser, Thr, Ala, Aib; (i) Gln at position 24 substituted with Ser, Thr, Ala, Aib; (j) Met at position 27 substituted with Leu or Nle; (k) Asn at position 29 substituted with a charged amino acid, optionally, Asp or Glu; and (l) Thr at position 29 substituted with Gly or a charged amino acid, optionally, Asp or Glu.

With regard to the analogs which exhibit agonist activity at the GIP receptor, the analog comprises an extension of 1-21 amino acids (e.g., 5-19, 7-15, 9-12 amino acids). The extension of the analog may comprise any amino acid sequence, provided that the extension is 1 to 21 amino acids. In some aspects, the extension is 7 to 15 amino acids and in other aspects, the extension is 9 to 12 amino acids. In some embodiments, the extension comprises (i) the amino acid sequence of SEQ ID NO: 26 or 674, (ii) an amino acid sequence which has high sequence identity (e.g., at least 80%, 85%, 90%, 95%, 98%, 99%) with the amino acid sequence of SEQ ID NO: 26 or 674, or (iii) the amino acid sequence of (i) or (ii) with one or more conservative amino acid modifications.

In some embodiments, at least one of the amino acids of the extension is acylated or alkylated. The amino acid comprising the acyl or alkyl group may be located at any position of extension of the analog. In certain embodiments, the acylated or alkylated amino acid of the extension is located at one of positions 37, 38, 39, 40, 41, or 42 (according to the numbering of SEQ ID NO: 1) of the analog. In certain embodiments, the acylated or alkylated amino acid is located at position 40 of the analog.

In exemplary embodiments, the acyl or alkyl group is an acyl or alkyl group which is non-native to a naturally-occurring amino acid. For example, the acyl or alkyl group may be a C4 to C30 (e.g., C12 to C18) fatty acyl group or C4 to C30 (e.g., C12 to C18) alkyl. The acyl or alkyl group may be any of those discussed herein.

In some embodiments, the acyl or alkyl group is attached directly to the amino acid, e.g., via the side chain of the amino acid. In other embodiments, the acyl or alkyl group is attached to the amino acid via a spacer (e.g., an amino acid, a dipeptide, a tripeptide, a hydrophilic bifunctional spacer, a hydrophobic bifunctional spacer). In certain aspects, the spacer is 3 to 10 atoms in length. In some embodiments, the amino acid spacer is not γ-Glu. In some embodiments, the dipeptide spacer is not γ-Glu-γ-Glu.

Also, in exemplary embodiments, the amino acid to which the acyl or alkyl group is attached may be any of those described herein, including, for example, an amino acid of Formula I, II, or III. The amino acid which is acylated or alkylated may be a Lys, for example. Suitable amino acids comprising an acyl or alkyl group, as well as suitable acyl groups and alkyl groups, are described herein. See, for example, the teachings under the sections entitled Acylation and Alkylation.

In other embodiments, 1-6 amino acids (e.g., 1-2, 1-3, 1-4, 1-5 amino acids) of the extension are positive-charged amino acids, e.g., amino acids of Formula IV, such as, for example, Lys. As used herein, the term "positive-charged amino acid" refers to any amino acid, naturally-occurring or non-naturally occurring, comprising a positive charge on an atom of its side chain at a physiological pH. In certain aspects, the positive-charged amino acids are located at any of positions 37, 38, 39, 40, 41, 42, and 43. In specific embodiments, a positive-charged amino acid is located at position 40.

In other instances, the extension is acylated or alkylated as described herein and comprises 1-6 positive charged amino acids as described herein.

In yet other embodiments, the analogs which exhibit agonist activity at the GIP receptor comprises (i) SEQ ID NO: 1 with at least one amino acid modification, (ii) an extension of 1 to 21 amino acids (e.g., 5 to 18, 7 to 15, 9 to 12 amino acids)C-terminal to the amino acid at position 29 of the analog, and (iii) an amino acid comprising an acyl or alkyl group which is non-native to a naturally-occurring amino acid which is located outside of the C-terminal extension (e.g., at any of positions 1-29). In some embodiments, the analog comprises an acylated or alkylated amino acid at position 10. In particular aspects, the acyl or alkyl group is a C4 to C30 fatty acyl or C4 to C30 alkyl group. In some embodiments, the acyl or alkyl group is attached via a spacer, e.g., an amino acid, dipeptide, tripeptide, hydrophilic bifunctional spacer, hydrophobic bifunctional spacer). In certain aspects, the analog comprises an amino acid modification which stabilizes the alpha helix, such as a salt bridge between a Glu at position 16 and a Lys at position 20, or an alpha, alpha-disubstituted amino acid at any one, two, three, or more of positions 16, 20, 21, and 24. In specific aspects, the analog additionally comprises amino acid modifications which confer DPP-IV protease resistance, e.g., DMIA at position 1, Aib at position 2. Analogs comprising further amino acid modifications are contemplated herein.

In certain embodiments, the analogs having GIP receptor activity exhibit at least 0.1% (e.g., at least 0.5%, 1%, 2%, 5%, 10%, 15%, or 20%) activity of native GIP at the GIP receptor. In some embodiments, the analogs exhibit more than 20% (e.g., more than 50%, more than 75%, more than 100%, more than 200%, more than 300%, more than 500%) activity of native GIP at the GIP receptor. In some embodiments, the analog exhibits appreciable agonist activity at one or both of the GLP-1 and glucagon receptors. In some aspects, the selectivity for these receptors (GIP receptor and GLP-1 receptor and/or glucagon receptor) are within 1000-fold. For example, the selectivity for the GLP-1 receptor of the analogs having GIP receptor activity can be less than 500-fold, 100-fold, within 50-fold, within 25 fold, within 15 fold, within 10 fold) the selectivity for the GIP receptor and/or the glucagon receptor.

In accordance with some embodiments, the Class 3 glucagon related peptide comprises the amino acid sequence of native glucagon (SEQ ID NO: 1) comprising the following modifications: Aib at position 2, Glu at position 3, Lys at position 10, Glu at position 16, Gln at position 17, Ala at position 18, Lys at position 20, Glu at position 21, Ile at position 23, Ala at position 24; wherein Lys at position 10 is acylated with a C14 or C16 fatty acid, and wherein the C-terminal carboxylate is replaced with an amide. In a specific embodiment, this Class 3 glucagon related peptide is attached via a linker (L) to a GPCR ligand (Y).

In accordance with some embodiments, the Class 3 glucagon related peptide comprises, consists essentially of, or consists of an amino acid sequence of any of SEQ ID NOs: 70-514, 517-534, or 554, optionally with up to 1, 2, 3, 4, or 5 further modifications that retain GLP-1 agonist and/or glucagon agonist activity. In certain embodiments, the Class 3 glucagon related peptide comprises the amino acids of any of SEQ ID NOs: 562-760. In some embodiments, the Class 3 glucagon related peptide comprises the amino acid sequences of any of SEQ ID NOs: 1301-1421.

Class 4 Glucagon Related Peptides

In certain embodiments, Q is a Class 4 glucagon related peptide (see, e.g., International (PCT) Patent Application Publication No. WO 2009/058662, incorporated herein by reference in its entirety.

All biological sequences referenced in the following section (SEQ ID NOs: 1301-1371) correspond to SEQ ID NOs: 1-71 in WO 2009/058662.

Activity

In accordance with some embodiments, Class 4 glucagon related peptides are provided (hereafter referred to as "Class 4 peptides"). In certain aspects a Class 4 peptide is provided which has glucagon antagonist activity. A glucagon antagonists would be used in any setting where the suppression of glucagon agonism is desired. The most immediate and obvious use would be in the treatment of diabetes where glucagon antagonism has been demonstrated in pre-clinical models of hyperglycemia to yield a lowering of blood glucose. Glucagon antagonists can be further modified to improve the biophysical stability and/or aqueous solubility of the compounds while maintaining the antagonist activity of the parent compound. In certain aspects a Class 4 peptide is defined as a pure glucagon antagonist.

The term "glucagon antagonist" refers to a compound that counteracts glucagon activity or prevents glucagon function. For example, a glucagon antagonist exhibits at least 60% inhibition (e.g., at least 70% inhibition) and preferably, at least 80% inhibition, of the maximum response achieved by glucagon at the glucagon receptor. In some embodiments, the glucagon antagonist exhibits at least 90% inhibition of the maximum response achieved by glucagon at the glucagon receptor. In a specific embodiment, the glucagon antagonist exhibits 100% inhibition of the maximum response achieved by glucagon at the glucagon receptor. Additionally, a glucagon antagonist at a concentration of about 1 μM exhibits less than about 20% of the maximum agonist activity achieved by glucagon at the glucagon receptor. In some embodiments, the glucagon antagonist exhibits less than about 10% of the maximum agonist activity achieved by glucagon at the glucagon receptor. In a specific embodiment, the glucagon antagonist exhibits less than about 5% of the maximum agonist activity achieved by glucagon at the glucagon receptor. In yet another specific embodiment, the glucagon antagonist exhibits 0% of the maximum agonist activity achieved by glucagon at the glucagon receptor.

A "pure glucagon antagonist" is a glucagon antagonist that does not produce any detected stimulation of glucagon or GLP-1 receptor activity, as measured by cAMP production using a validated in vitro model assay (see, e.g., WO 2009/058662). For example, a pure glucagon antagonist exhibits less than about 5% (e.g., less than about 4%, less than about 3%, less than about 2%, less than about 1%, about 0%) of the maximum agonist activity achieved by glucagon at the glucagon receptor and exhibits less than about 5% (e.g., less than about 4%, less than about 3%, less than about 2%, less than about 1%, and about 0%) of the maximum agonist activity achieved by GLP-1 at the GLP-1 receptor.

Accordingly, in some aspects, there is provided Class 4 peptides that exhibit pure glucagon antagonist activity. In accordance with some embodiments the glucagon antagonist exhibits activity that reduces glucagon receptor glucagon-induced cAMP production by a maximum of at least 50% when the glucagon receptor is contacted simultaneously with 0.8 nM of glucagon and the glucagon antagonist, as measured by cAMP production in an in vitro assay. In some embodiments, the glucagon antagonist reduces glucagon receptor glucagon-induced cAMP production by a maximum amount of at least 80%.

Class 4 peptides are believed to be suitable for any use that has previously been described for glucagon antagonists. Accordingly, the Class 4 peptides described herein can be used to treat hyperglycemia, or treat other metabolic diseases that result from high blood levels of glucagon or high blood glucose levels. In accordance with some embodiments the patient to be treated using the Class 4 peptides disclosed herein is a domesticated animal, and in another embodiment the patient to be treated is a human. Studies suggest that lack of glucagon suppression in diabetic patients contributes to postprandial hyperglycemia in part via accelerated glycogenolysis. Analysis of blood glucose during an Oral Glucose Tolerance Test (OGTT), and in the presence or absence of somatostatin-induced glucagon suppression, has shown a significant increase in glucose in subjects with higher glucagon levels. Accordingly, the Class 4 peptides of the present invention can be used to treat hyperglycemia, and are expected to be useful for treating a variety of types of diabetes including diabetes mellitus type I, diabetes mellitus type II, or gestational diabetes, either insulin-dependent or non-insulin-dependent, and reducing complications of diabetes including nephropathy, retinopathy and vascular disease.

In some embodiments the terminal ten amino acids of Exendin-4 (i.e. the sequence of SEQ ID NO: 1319 (GPSSGAPPPS)) are linked to the carboxy terminus of a Class 4 peptide. These fusion proteins are anticipated to have pharmacological activity for suppressing appetite and inducing weight loss/weight maintenance. In accordance with some embodiments the Class 4 peptides disclosed herein can be further modified to include the amino acid sequence of SEQ ID NO: 1319 (GPSSGAPPPS) linked to amino acid 24 of the Class 4 peptide of SEQ ID NO: 1342 and administered to individuals to induce weight loss or assist in weight maintenance. More particularly, the Class 4 peptide comprises a sequence selected from the group consisting of SEQ ID NO: 1302, SEQ ID NO: 1303, SEQ ID NO: 1304 SEQ ID NO: 1305, SEQ ID NO: 1306, SEQ ID NO: 1307, SEQ ID NO: 1308, SEQ ID NO: 1336, SEQ ID NO: 1339, SEQ ID NO: 1340 SEQ ID NO: 1341, SEQ ID NO: 1342, SEQ ID NO: 1343 and SEQ ID NO: 1344 and further comprising the amino acid sequence of SEQ ID NO: 1319 (GPSSGAPPPS) linked to amino acid 24 of the Class 4 peptide is used to suppress appetite and inducing weight loss/weight maintenance. In some embodiments the administered Class 4 peptide comprises the sequence of SEQ ID NO: 1346 or SEQ ID NO: 1347.

Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

The Class 4 peptides of the invention may be administered alone or in combination with other anti-diabetic or anti-obesity agents. Anti-diabetic agents known in the art or under investigation include insulin, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARγ inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; or FBPase (fructose 1,6-bisphosphatase) inhibitors.

Anti-obesity agents known in the art or under investigation include appetite suppressants, including phenethylamine type stimulants, phentermine (optionally with fenfluramine or dexfenfluramine), diethylpropion (Tenuate®), phendimetrazine (Prelu-2®, Bontril®), benzphetamine (Didrex®), sibutramine (Meridia®, Reductil®); rimonabant (Acomplia®), other cannabinoid receptor antagonists; oxyntomodulin; fluoxetine hydrochloride (Prozac); Qnexa (topiramate and phentermine), Excalia (bupropion and zonisamide) or Contrave (bupropion and naltrexone); or lipase inhibitors, similar to xenical (Orlistat) or Cetilistat (also known as ATL-962), or GT 389-255.

The Class 4 peptides of the present invention can also be administered to patients suffering from catabolic wasting. It is estimated that over half of cancer patients experience catabolic wasting which is characterized by unintended and progressive weight loss, weakness, and low body fat and muscle. The syndrome is equally common in AIDS patients and can also be present in bacterial and parasitic diseases, rheumatoid arthritis, and chronic diseases of the bowel, liver, lungs, and heart. It is usually associated with anorexia and can manifest as a condition in aging or as a result of physical trauma. Catabolic wasting is a symptom that diminishes the quality of life, worsens the underlying condition, and is a major cause of death. Applicants anticipate that the Class 4 peptides disclosed herein can be administered to patients to treat catabolic wasting.

Pharmaceutical compositions comprising the Class 4 peptides disclosed herein can be formulated and administered to patients to using standard pharmaeuctically acceptable carriers and routes of administration known to those skilled in the art. Accordingly the present disclosure also encompasses pharmaceutical compositions comprising one or more of the Class 4 peptides disclosed herein in combination with a pharmaceutically acceptable carrier. The pharmaceutical compositions may comprise the Class 4 peptides as the sole pharmaceutically active component, or the Class 4 peptides can be combined with one or more additional active agents. In accordance with some embodiments a composition is provided comprising a Class 4 peptide of the present invention and a compound that activates the GLP-1 receptor (such as GLP-1, a GLP-1 analog, an exendin-4 analog, or derivatives thereof). In accordance with some embodiments a composition is provided comprising a Class 4 peptide of the present invention and insulin or an insulin analog. Alternatively, a composition provided for inducing weight loss or preventing weight gain can be provided that comprises the sequence of SEQ ID NO: 1342 further comprising the amino acid sequence of SEQ ID NO: 1319 (GPSSGAPPPS) linked to amino acid 24 of SEQ ID NO: 1342, and an anti-obesity peptide. Suitable anti-obesity peptides include those disclosed in U.S. Pat. Nos. 5,691,309, 6,436,435 or US Patent application 20050176643, and including, but not limited to GLP-1, GIP (Gastric Inhibitory Polypeptide), MP1, PYY, MC-4, Leptin.

Class 4 Peptide Structure

In some embodiments Class 4 glucagon related peptides are provided wherein the normally occurring aspartic acid at position nine (of glucagon, SEQ ID NO: 1301) has been substituted with glutamic acid or a cysteic acid-based derivative. More particularly, deletion of the first amino acid (des-His) and substitution of the aspartic acid at position 9 with glutamic acid, in some aspects, produces a Class 4 peptide. Class 4 glucagon related peptides having sulfonic acid substituents substituted at amino acid position nine of glucagon perform similarly to the carboxylic acid-based amino acids but with a few critical differences in relation to physical properties such as solubility. Homocysteic acid (hCysSO3) when substituted for the isosteric glutamic acid at position nine in the conventional des-His, Glu9 Class 4 peptide retains a partial antagonist and weak agonist.

In some embodiments there is provided a Class 4 peptide wherein the first two to five amino acids are removed, and position 9 (according to the numbering of SEQ ID NO: 1301) is replaced with hCys(SO3), homoglutamic acid, β-homoglutamic acid, or an alkylcarboxylate derivative of cysteine having the structure of:

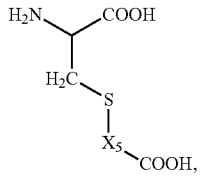

wherein X5 is C1-C4 alkyl, C2-C4 alkenyl, or C2-C4 alkynyl, provides a compound that performs as a hormonal antagonist that is highly specific, potent and without contaminating agonist properties.

In accordance with some embodiments a Class 4 peptide is provided that comprises a glucagon peptide modified, relative to the wild type sequence of SEQ ID NO: 1301, by the deletion of two to five amino acid residues from the N-terminus and substitution of the aspartic acid residue at position nine of the native protein with a glutamic acid, homoglutamic acid, β-homoglutamic acid, a sulfonic acid derivative of cysteine, or an alkylcarboxylate derivative of cysteine having the structure of:

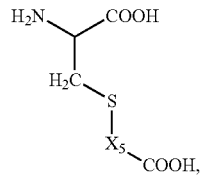

wherein $X_5$ is C1-C4 alkyl, C2-C4 alkenyl, or C2-C4 alkynyl.

In one specific embodiment, the Class 4 peptide comprising the deletion of two to five amino acid residues from the N-terminus and substitution of the Asp at position 9 of the native glucagon, is further modified by up to three amino acid modifications. For example, the Class 4 peptide may comprise one, two, or three conservative amino acid modifications. Alternatively or additionally, the Class 4 peptide may comprise one or more amino acid modifications selected from the group consisting of:

A. substitution of one or two amino acids at positions 10, 20, and 24, (according to the amino acid numbering of SEQ ID NO: 1301), or the N- or C-terminal amino acid of the Class 4 peptide with an amino acid covalently attached to an acyl group or alkyl group via an ester, ether, thioether, amide, or alkyl amine linkage;

B. substitution of one or two amino acids at positions 16, 17, 20, 21, and 24 (according to the amino acid numbering of SEQ ID NO: 1301), or the N- or C-terminal amino acid of the Class 4 peptide with an amino acid selected from the group consisting of: Cys, Lys, ornithine, homocysteine, and acetyl-phenylalanine (Ac-Phe), wherein the amino acid of the group is covalently bonded to a hydrophilic moiety;

C. addition of an amino acid covalently bonded to a hydrophilic moiety to the N- or C-terminus of the Class 4 peptide;

D. substitution of Asp at position 15 (according to the numbering of SEQ ID NO: 1301) with cysteic acid, glutamic acid, homoglutamic acid, and homocysteic acid;

E. substitution of Ser at position 16 (according to the numbering of SEQ ID NO: 1301) with cysteic acid, glutamic acid, homoglutamic acid, and homocysteic acid;

F. substitution with Aib at one or more of positions 16, 20, 21, and 24 according to the amino acid numbering of SEQ ID NO: 1301;

G. deletion of the amino acid at position 29 or the amino acids at positions 28 and 29, according to the numbering of SEQ ID NO: 1301;

H. substitution of each or both of the Asn at position 28 and the Thr at position 29 (according to the amino acid numbering of SEQ ID NO: 1301) with charged amino acids; and/or addition of one to two charged amino acids at the C-terminus of SEQ ID NO: 1301;

I. substitution of the Met at position 27 (according to the numbering of SEQ ID NO: 1301) with Leu or norleucine;

J. addition of a peptide having the amino acid sequence of any of SEQ ID NOs: 19-21 and 53 to the C-terminus of SEQ ID NO: 1301; wherein Thr at position 29 (according to the numbering of SEQ ID NO: 1301) is Thr or Gly; and K. replacement of the C-terminal carboxylate with an amide or ester.

In a specific embodiment, the Class 4 peptide comprises an amino acid modification of A, B, or C, as described above, or a combination thereof. In yet another specific embodiment, the Class 4 peptide further comprises an amino acid modification of any of D to K as described above, or a combination thereof, in addition to the amino acid modification(s) of A, B, and/or C.

In some embodiments the Class 4 peptide comprises a glucagon peptide, wherein the first 5 amino acids have been removed from the N-terminus, and the remaining N-terminal amino group has been replaced with a hydroxyl group (the "PLA6 analog"), producing the peptide of SEQ ID NO: 1339. Applicants have found that substitution of phenyl-lactic acid for phenylalanine in Class 4 peptide analogs that have the first five amino acids deleted and substitution of a glutamic acid at position 9 (relative to native glucagon) further enhances the potency of those Class 4 peptide analogs.

In some embodiments the Class 4 peptide peptide of SEQ ID NO: 1339 is further modified by substituting the aspartic acid residue at position four (position 9 of the native glucagon) with an amino acid of the general structure:

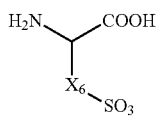

wherein $X_6$ is C1-C3 alkyl, C2-C3 alkene or C2-C3 alkynyl, and in some embodiments X6 is C1-C3 alkyl, and in another embodiment X6 is C2 alkyl. In some embodiments the Class 4 peptide comprises a glucagon peptide, wherein the first 5 amino acids have been removed from the N-terminus, and the aspartic acid residue at position four (position 9 of the native glucagon) has been substituted with cysteic acid or homocysteic acid. In some embodiments the Class 4 peptide comprises a glucagon peptide comprising an amino acid sequence selected from the group consisting of SEQ ID NO: 1339, SEQ ID NO: 1307 and SEQ ID NO: 1308. In some embodiments the Class 4 peptide comprises an amino acid sequence selected from the group consisting of SEQ ID NO: 1308, wherein the amino acid at position four is homocysteic acid.

In another embodiment, the Class 4 peptide of SEQ ID NO: 1339 is further modified by substituting the aspartic acid residue at position four (position 9 of the native glucagon) with glutamic acid, homoglutamic acid, β-homoglutamic acid, or an alkylcarboxylate derivative of cysteine having the structure of:

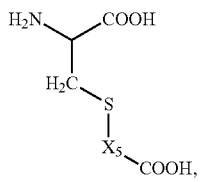

wherein $X_5$ is C1-C4 alkyl, C2-C4 alkenyl, or C2-C4 alkynyl. In a specific embodiment, $X_5$ is C1 or C2 alkyl.

However, applicants have discovered that with the substitution of the N-terminal phenylalanine with PLA in a des1-5 glucagon analog (i.e., a glucagon analog having the first five amino acids deleted), further substitution of the native aspartic acid residue at position four (position 9 of the native glucagon) is not required to produce an analog that exhibits pure antagonism. This result is surprising in light of the prior art teachings that the native aspartic acid residue at position four must substituted to produce high affinity and potent antagonists of glucagon (2-29) analogs. The use of the PLA substitution improves the relative potency of the Asp9 analog to a point comparable to that of the Glu9 and hCys(SO₃H)9 analogs.

Substitution of the phenylalanine residue with other phenylalanine analogs, including 3,4-2F-phenylalnine (3,4-2F-Phe), 2-naphthyalanine (2-Nal), N-acyl-phenylalanine (Ac-Phe), alpha-methylhydrocinnamic acid (MCA) and benzylmalonic acid (BMA) did not perform as potently as the PLA substitution.

Substituting PLA at sites other than at position six (according to the amino acid numbering of native glucagon), including at positions 4 and 5 reveals that the PLA6 analog is an appreciably more potent antagonist than glucagon analogs having a slightly extended N-terminus. The present invention also includes analogs wherein the N-terminal amino group is substituted with an acylated and alkylated "O-terminal" peptides.

Furthermore, the PLA6 substitution not only increases the potency of the antagonist but also serves a critical role in pegylation. The PLA6 analogs can be selectively pegylated without restoration of glucagon agonism. In the absence of the PLA substitution, pegylation of the analog surprisingly induces glucagon agonism. This glucagon agonism is not seen in the pegylated PLA6 analogs. Several sites for pegylation were investigated including positions 3, 6 and 19 (positions 8, 11 and 19 of native glucagon) and at the N-terminal amino acid residue. In some embodiments the pegylation is at position 19 (position 24 of native glucagon) as that site exhibits the most potent and selective glucagon antagonism.

In some embodiments, the Class 4 peptide comprises the general structure of A-B-C, wherein A is selected from the group consisting of:
(i) phenyl lactic acid (PLA);
(ii) an oxy derivative of PLA;
(iii) a peptide of 2 to 6 amino acids in which two consecutive amino acids of the peptide are linked via an ester or ether bond; B represents amino acids i to 26 of SEQ ID NO: 1301, wherein i is 3, 4, 5, 6, or 7, optionally comprising one or more amino acid modifications selected from the group consisting of:
(iv) Asp at position 9 (according to the amino acid numbering of SEQ ID NO: 1301) is substituted with a Glu, a sulfonic acid derivative of Cys, homoglutamic acid, β-homoglutamic acid, or an alkylcarboxylate derivative of cysteine having the structure of:

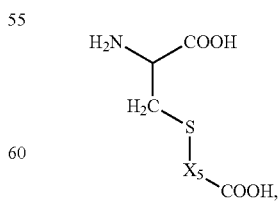

wherein X5 is C1-C4 alkyl, C2-C4 alkenyl, or C2-C4 alkynyl.
(v) substitution of one or two amino acids at positions 10, 20, and 24, (according to the amino acid numbering of SEQ ID NO: 1301) with an amino acid covalently attached to an acyl or alkyl group via an ester, ether, thioether, amide, or alkyl amine linkage;

(vi) substitution of one or two amino acids at positions 16, 17, 20, 21, and 24 (according to the amino acid numbering of SEQ ID NO: 1301) with an amino acid selected from the group consisting of: Cys, Lys, ornithine, homocysteine, and acetyl-phenylalanine (Ac-Phe), wherein the amino acid of the group is covalently attached to a hydrophilic moiety;

(vii) Asp at position 15 (according to the numbering of SEQ ID NO: 1301) is substituted with cysteic acid, glutamic acid, homoglutamic acid, and homocysteic acid;

(viii) Ser at position 16 (according to the numbering of SEQ ID NO: 1301) is substituted with cysteic acid, glutamic acid, homoglutamic acid, and homocysteic acid;

(ix) substitution with Aib at one or more of positions 16, 20, 21, and 24 according to the amino acid numbering of SEQ ID NO: 1301;

and C is selected from the group consisting of:

(x) X;
(xi) X-Y;
(xii) X-Y-Z; and
(xiii) X-Y-Z-R10, wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid; wherein R10 is selected from a group consisting of SEQ ID NOs: 1319-1321 and 1353; and (xiv) any of (x) to (xiii) in which the C-terminal carboxylate is replaced with an amide.

In a specific aspect, the Class 4 peptide comprises an oxy derivative of PLA. As used herein "oxy derivative of PLA" refers to a compound comprising a modified structure of PLA in which the hydroxyl group has been replaced with O—$R_{11}$, wherein $R_{11}$ is a chemical moiety. In this regard, the oxy derivative of PLA can be, for example, an ester of PLA or an ether of PLA.

Methods of making oxy derivatives of PLA are known in the art. For example, when the oxy derivative is an ester of PLA, the ester may be formed by upon reaction of the hydroxyl of PLA with a carbonyl bearing a nucleophile. The nucleophile can be any suitable nucleophile, including, but not limited to an amine or hydroxyl. Accordingly, the ester of PLA can comprise the structure of Formula IV:

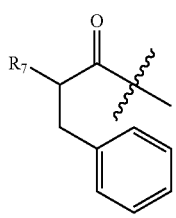

Formula IV wherein $R_7$ is an ester formed upon reaction of the hydroxyl of PLA with a carbonyl bearing a nucleophile.

The carbonyl bearing a nucleophile (which reacts with the hydroxyl of PLA to form an ester) can be, for example, a carboxylic acid, a carboxylic acid derivative, or an activated ester of a carboxylic acid. The carboxylic acid derivative can be, but is not limited to, an acyl chloride, an acid anhydride, an amide, an ester, or a nitrile. The activated ester of a carboxylic acid can be, for example, N-hydroxysuccinimide (NHS), tosylate (Tos), a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yl-oxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

Methods of making ethers from reaction with a hydroxyl group (e.g., the hydroxyl of PLA) also are known in the art. For example, the hydroxyl group of PLA may be reacted with a halogenated alkyl or tosylated alkyl alcohol to form an ether bond.

Generally, the chemical moiety of $R_{11}$ is one which does not decrease the activity of the Class 4 peptide. In some embodiments, the chemical moiety enhances the activity, stability, and/or solubility of the Class 4 peptide.

In a specific embodiment, the chemical moiety bound to PLA via an oxygen-containing bond (e.g., via an ester or ether bond) is a polymer (e.g., a polyalkylene glycol), a carbohydrate, an amino acid, a peptide, or a lipid, e.g., a fatty acid or a steroid.

In a specific embodiment, the chemical moiety is an amino acid, which, optionally, is a part of a peptide, such that Formula IV is a depsipeptide. In this regard, PLA may be at a position other than the N-terminal amino acid residue of the Class 4 peptide, such that the Class 4 peptide comprises one or more (e.g., 1, 2, 3, 4, 5, 6, or more) amino acids N-terminal to the PLA residue. For example, the Class 4 peptide can comprise PLA at position n, wherein n is 2, 3, 4, 5, or 6 of the Class 4 peptide.

The amino acids N-terminal to the PLA residue may be synthetic or naturally-occurring. In a specific embodiment, the amino acids which are N-terminal PLA are naturally-occurring amino acids. In some embodiments, the amino acids which are N-terminal to PLA are the N-terminal amino acids of native glucagon. For example, the Class 4 peptide can comprise at the N-terminus the amino acid sequence of any of SEQ ID NOs: 1354-1358, wherein PLA is linked to threonine via an ester bond:

```
His-Ser-Gln-Gly-Thr-PLA    SEQ ID NO: 1354

Ser-Gln-Gly-Thr-PLA        SEQ ID NO: 1355

Gln-Gly-Thr-PLA            SEQ ID NO: 1356

Gly-Thr-PLA                SEQ ID NO: 1357

Thr-PLA                    SEQ ID NO: 1358
```

In an alternative embodiment, one or more of the N-terminal amino acids may be substituted with an amino acid other than the amino acid of native glucagon. For example, when the Class 4 peptide comprises PLA as the amino acid at position 5 or 6, the amino acid at position 1 and/or position 2 may be an amino acid which reduces susceptibility to cleavage by dipeptidyl peptidase IV. More particularly, in some embodiments, position 1 of the Class 4 peptide is an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist peptide is an amino acid selected from the group consisting of D-serine, D-alanine, valine, glycine, N-methyl serine, N-methyl alanine, and aminoisobutyric acid (Aib). Also, for example, when the Class 4 peptide comprises PLA as the amino acid at position 4, 5, or 6, the amino acid at position 3 of the Class 4 peptide may be glutamic acid, as opposed to the native glutamine residue of native glucagon. In an exemplary embodiment of the invention, the Class 4 peptide comprises at the N-terminus the amino acid sequence of any of SEQ ID NOs: 1359-1361.

With respect to the Class 4 peptides comprising a compound of Formula IV, the polymer may be any polymer, provided that it can react with the hydroxyl group of PLA. The polymer may be one that naturally or normally comprises a carbonyl bearing a nucleophile. Alternatively, the polymer may be one which was derivatized to comprise the carbonyl bearing the carbonyl. The polymer may be a derivatized polymer of any of: polyamides, polycarbonates, polyalkylenes and derivatives thereof including, polyalkylene glycols, polyalkylene oxides, polyalkylene terepthalates, polymers of acrylic and methacrylic esters, including poly(methyl methacrylate), poly(ethyl methacrylate), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

The polymer can be a biodegradable polymer, including a synthetic biodegradable polymer (e.g., polymers of lactic acid and glycolic acid, polyanhydrides, poly(ortho)esters, polyurethanes, poly(butic acid), poly(valeric acid), and poly(lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

The polymer can be a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate).

In some embodiments, the polymer is a water-soluble polymer. Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene co-polymer, polyoxyethyleneglycols, polyethylene oxide, and derivatives, salts, and combinations thereof.

In a specific embodiment, the polymer is a polyalkylene glycol, including, for example, polyethylene glycol (PEG).

The carbohydrate may be any carbohydrate provided that it comprises or is made to comprise a carbonyl with an alpha leaving group. The carbohydrate, for example, may be one which has been derivatized to comprise a carbonyl with an alpha leaving group. In this regard, the carbohydrate may be a derivatized form of a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

With respect to the Class 4 peptides comprising a compound of Formula IV, the lipid may be any lipid comprising a carbonyl with an alpha leaving group. The lipid, for example, may be one which is derivatized to comprise the carbonyl. In this regard, the lipid, may be a derivative of a fatty acid (e.g., a C4-C30 fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide. In some embodiments, the lipid is a oil, wax, cholesterol, sterol, fat-soluble vitamin, monoglyceride, diglyceride, triglyceride, a phospholipid.

In some embodiments, $R_7$ has a molecular weight of about 100 kDa or less, e.g., about 90 kDa or less, about 80 kDa or less, about 70 kDa or less, about 60 kDa or less, about 50 kDa or less, about 40 kDa or less. Accordingly, R7 can have a molecular weight of about 35 kDa or less, about 30 kDa or less, about 25 kDa or less, about 20 kDa or less, about 15 kDa or less, about 10 kDa or less, about 5 kDa or less, or about 1 kDa.

In an alternative embodiment, the Class 4 peptide comprises as A, a peptide of 2 to 6 amino acids in which two consecutive amino acids of the peptide are linked via an ester or ether bond. The ester or ether bond may be, e.g., between amino acids 2 and 3, 3 and 4, 4 and 5, or 5 and 6. Optionally the peptide may be further modified by covalent linkage to another chemical moiety including linkage to a polymer (e.g. a hydrophilic polymer), alkylation, or acylation.

With regard to the Class 4 peptide comprising the general structure A-B-C, B represents amino acids of native glucagon, e.g., i to 26 of SEQ ID NO: 1301, wherein i is 3, 4, 5, 6, or 7, optionally comprising one or more amino acid modifications. In a specific embodiment, B represents amino acids 7 to 26 of SEQ ID NO: 1301, optionally further modified.

In some embodiments, B is modified by up to three amino acid modifications. For example, B, which represents native amino acid sequence of SEQ ID NO: 1301 is modified by one or more conservative amino acid modifications.

In another embodiment, B comprises one or more amino acid modifications selected from the group consisting of (iv) to (ix), as described herein. In a specific embodiment, B comprises one or both of the amino acid modifications (v) and (vi). In a further specific embodiment, B comprises one or a combination of amino acid modifications selected from the group consisting of (iv), (vii), (viii), and (ix), in addition to (v) and (vi).

In another specific embodiment, the Class 4 peptide comprises one or more charged amino acids at the C-terminus. For example, Y and/or Z can be a charged amino acid, e.g., Lys, Arg, His, Asp, and Glu. In yet another embodiment, the Class 4 peptide comprises one to two charged amino acids (e.g., Lys, Arg, His, Asp, and Glu)C-terminal to Z. In a specific aspect, Z followed by one to two charged amino acids does not comprise R10.

The Class 4 peptide in some embodiments comprises a hydrophilic moiety covalently bound to an amino acid residue of the Class 4 peptide, as described herein. For example, the Class 4 peptide can comprise a hydrophilic moiety covalently attached to an amino acid at position 1, 16, 20, 21, or 24 according to the numbering of SEQ ID NO: 1301. In another embodiment, the hydrophilic moiety is attached to the C-terminal amino acid of the Class 4 peptide, which in some cases, is 1 or 11 amino acids C-terminal to Z. In yet another embodiment, the hydrophilic moiety is attached to PLA, when A is PLA, PLA-Phe, or PLA-Thr-Phe, wherein PLA is modified to comprise the hydrophilic moiety. In another embodiment, an amino acid comprising a hydrophilic moiety is added to the N- or C-terminus of the Class 4 peptide. In another embodiment, the Class 4 peptide comprises an acyl group or alkyl group as described herein. For example, the acylation or alkylation can occur off the side chain of the amino acid at position 10, 20, or 24, according to the numbering of SEQ ID NO: 1301. In an alternative embodiment, the acylation or alkylation occurs off the side chain of the C-terminal amino acid of the Class 4 peptide, which in some cases, is 1 or 11 amino acids C-terminal to Z. In yet another embodiment, when A is PLA, PLA-Phe, or PLA-Thr-Phe, the PLA is modified to comprise an acyl or alkyl group.

Exemplary Embodiments

The Class 4 peptide may comprise any amino acids, synthetic or naturally occurring, provided that at least two consecutive amino acids of the peptide are linked via an ester or ether bond. In a specific embodiment, the peptide comprises amino acids of native glucagon. For example, the peptide can comprise j to 6 of native glucagon (SEQ ID NO: 1301), wherein j is 1, 2, 3, 4, or 5. Alternatively, the peptide can comprise an amino acid sequence based on the N-terminus of SEQ ID NO: 1301 with one or more amino acid modifications. The amino acid at position 1 and/or position 2 may be an amino acid which reduces susceptibility to cleavage by dipeptidyl peptidase IV. For instance, the peptide can comprise at position 1 of the Class 4 peptide an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist peptide is an amino acid selected from the group consisting of D-serine, D-alanine, valine, glycine, N-methyl serine, N-methyl alanine, and aminoisobutyric acid (Aib). Also, for example, the amino acid at position 3 of the Class 4 peptide may be glutamic acid, as opposed to the native glutamine residue of native glucagon. Accordingly, the Class 4 peptide can comprise an amino acid sequence of:

```
Xaa1-Xaa2-Xaa3-Thr-Gly-Phe;    (SEQ ID NO: 1368)

Xaa2-Xaa3-Thr-Gly-Phe;         (SEQ ID NO: 1369)
or

Xaa3-Thr-Gly-Phe;              (SEQ ID NO: 1370)
``` wherein Xaa1 is selected from a group consisting of: His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine; Xaa2 is selected from a group consisting of: Ser, D-serine, D-alanine, valine, glycine, N-methyl serine, N-methyl alanine, and aminoisobutyric acid (Aib); and Xaa3 is Gln or Glu.

The present invention also encompasses embodiments wherein the C-terminal amino acid of the Class 4 peptides have an amide group substituting for the carboxylic acid group that is present on the native amino acid.

In some embodiments, wherein the Class 4 peptide is PEGylated, the Class 4 peptide comprises the shortened glucagon peptides, specifically 6-29 where the "N-terminal" amino acid is PLA (phenyl-lactic acid). Such glucagon derivatives exhibit unique virtues. They are more potent peptides than those with the native N-terminal phenylalanine and they suppress any glucagon agonism that results from pegylation, something not seen with the native phenylalanine. Finally, while the current literature establishes that a substitution of the native aspartic acid at position 9 is required for antagonist activity, applicants have discovered the surprising result that such a substitution is no longer required in the PLA6-(6-29) glucagon analogs.

In some embodiments an amino acid of the Class 4 peptide is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, an amino acid of the Class 4 peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In accordance with some embodiments the lysine residue corresponding to position 12 of the native peptide is substituted with arginine and a single lysine substitution is inserted for one of the amino acids corresponding to position 1, 16, 17, 20, 21, 24 or 29 of the native peptide, or a lysine is added to the N- or C-terminus of the Class 4 peptide.

In another embodiment the methionine residue corresponding to position 27 of the native peptide is changed to leucine or norleucine to prevent oxidative degradation of the peptide.

In some embodiments, the Class 4 peptides described herein are further modified by truncation or deletion of one or two amino acids of the C-terminus of the glucagon peptide (i.e., truncation of the amino acid at position 29 or at positions 28 and 29 of native glucagon) without affecting activity and/or potency at the glucagon receptor. In this regard, the Class 4 peptide described herein can, for example, consist essentially of or consist of amino acids 1-27, 1-28, 2-27, 2-28, 3-27, 3-28, 4-27, 4-28, 5-27, 5-28, 6-27, or 6-28 of the native glucagon peptide (SEQ ID NO: 1301) with one or more modifications resulting in Class 4 peptidic activity as described herein.

The presently disclosed Class 4 peptides also encompass amino acid substitutions at positions that are known not to be critical to the function of the glucagon peptide. In some embodiments the substitutions are conservative amino acid substitutions at one, two or three positions selected from the group consisting of 2, 5, 6, 7, 8, 9, 12, 13, 14, 15, 16, 19, 22, 23 or 24 of SEQ ID NO: 1339. In some embodiments the Class 4 peptide comprises a derivative peptide of SEQ ID NO: 1342 wherein the glucagon peptide comprises a further amino acid substitution relative to SEQ ID NO: 1342 at one to three amino acid positions selected from positions 2, 5, 6, 8, 9, 12, 13 and 14. In some embodiments the substitutions at positions 2, 5, 6, 8, 9, 12, 13 and 14 of SEQ ID NO: 1342 are conservative amino acid substitutions. In some embodiments the amino acids corresponding to positions 16, 17, 20, 21, 24 or 29 of the native peptide, and more particularly at position 21 and/or 24 are substituted with cysteine or lysine, wherein a PEG chain is covalently attached to the substituted cysteine or lysine residue.

In accordance with some embodiments the modified Class 4 peptide comprises two or more polyethylene glycol chains covalently bound to the peptide wherein the total molecular weight of the glucagon chains is about 1,000 to about 5,000 Daltons. In some embodiments the pegylated Class 4 peptide comprises a peptide selected from the group consisting of SEQ ID NO: 1312, and SEQ ID NO: 1322, wherein said peptide comprise a polyethylene glycol chain linked to the amino acid at positions 11 and 19 and the combined molecular weight of the two PEG chains is about 1,000 to about 5,000 Daltons.

In accordance with some embodiments a Class 4 peptide is provided comprising a modified glucagon peptide selected from the group consisting of:

(SEQ ID NO: 1309)
R$_1$-Phe-Thr-Ser-Xaa-Tyr-Ser-Xaa-Tyr-Leu-Xaa-Xaa-

Arg-Arg-Ala-Gln-Asp-Phe-Val-Gln-Trp-Leu-Xaa-Asn-

Thr-R$_2$, (SEQ ID NO: 1310)
R$_1$-Phe-Thr-Ser-Xaa-Tyr-Ser-Xaa-Tyr-Leu-Asp-Ser-

Arg-Arg-Ala-Gln-Xaa-Phe-Val-Gln-Trp-Leu-Xaa-Asn-

Thr-R$_2$, (SEQ ID NO: 1311)
R$_1$-Phe-Thr-Ser-Xaa-Tyr-Ser-Xaa-Tyr-Leu-Asp-Ser-

Arg-Arg-Ala-Gln-Asp-Phe-Val-Xaa-Trp-Leu-Xaa-Asn-

Thr-R$_2$
and (SEQ ID NO: 1312)
R$_1$-Phe-Thr-Ser-Xaa-Tyr-Ser-Xaa-Tyr-Leu-Asp-Ser- Arg-Arg-Ala-Gln-Xaa-Phe-Val-Xaa-Trp-Leu-Xaa-Asn- Thr-R$_2$, wherein Xaa at position 4=aspartic acid, glutamic acid, cysteic acid or homocysteic acid, Xaa at position 7=Lys or Arg, Xaa at position 10 is aspartic acid, cysteic acid, glutamic acid, homoglutamic acid and homocysteic acid; Xaa at position 11 is Ser, Lys, Cys, Orn, homocysteine or acetyl phenylalanine, Xaa at position 16 is Asp, Lys, Cys, Orn, homocysteine or acetyl phenylalanine and Xaa at position 19 is Gln, Lys, Cys, Orn, homocysteine and acetyl phenylalanine, Xaa at position 22=Met, Leu or Nle, R1 is OH or NH$_2$, and R$_2$ is COOH or CONH$_2$, wherein the peptide is pegylated at position 11 for SEQ ID NO: 1309, at position 16 for SEQ ID NO: 1310, position 19 for SEQ ID NO: 1311 and at positions 16 and 19 of SEQ ID NO: 1312, with the proviso that when Xaa at position 4=aspartic acid then R$_1$ is OH. In accordance with some embodiments the peptide comprises the sequence of SEQ ID NO: 1309, SEQ ID NO: 1310 or SEQ ID NO: 1311, wherein R$_1$ is OH and R$_2$ is CONH$_2$. In some embodiments the peptide comprises the sequence of SEQ ID NO: 1309, SEQ ID NO: 1310 or SEQ ID NO: 1311, wherein R$_1$ is OH, R$_2$ is CONH$_2$ and the amino acid at position 4 is aspartic acid, and in a further embodiment such peptides comprise a carboxy terminal extension comprising the sequence of SEQ ID NO: 1319.

In accordance with some embodiments the peptide comprises a sequence selected from the group consisting of SEQ ID NO: 1309, SEQ ID NO: 1310, SEQ ID NO: 1313, SEQ ID NO: 1314, and SEQ ID NO: 1316, wherein the peptide is pegylated at position 11 for SEQ ID NO: 1309 and SEQ ID NO: 1313, pegylated at position 16 for SEQ ID NO: 1310, and pegylated at position 19 for SEQ ID NO: 1310 and SEQ ID NO: 1314. In some embodiments the glucagon agonist comprises the peptide of SEQ ID NO: 1313 or SEQ ID NO: 1314. In some embodiments the C-terminal amino acid of the Class 4 peptides disclosed herein have an amide group in place of the carboxylic acid group that is present on the native amino acid. In accordance with some embodiments the Class 4 peptide comprises the sequence of SEQ ID NO: 1318.

In accordance with some embodiments, a Class 4 peptide is provided wherein a plasma protein has been covalently linked to an amino acid side chain of the peptide to improve the solubility, stability and/or pharmacokinetics of the glucagon peptide. For example, serum albumin can be covalently bound to the Class 4 peptides presented herein. In some embodiments the plasma protein is covalently bound to an amino acid corresponding to position 16, 17, 20, 21, 24 or 29 of the native glucagon peptide. More particularly, in some embodiments the plasma protein is bound to an amino acid corresponding to position 16 or 24 of the native glucagon peptide, wherein the Class 4 peptide comprises the sequence of SEQ ID NO: 1303, SEQ ID NO: 1304, SEQ ID NO: 1305, SEQ ID NO: 1306, SEQ ID NO: 1307, SEQ ID NO: 1308, SEQ ID NO: 1309, SEQ ID NO: 1311, SEQ ID NO: 1312, SEQ ID NO: 1322, SEQ ID NO: 1323, SEQ ID NO: 1324, SEQ ID NO: 1325, SEQ ID NO: 1326, SEQ ID NO: 1327, SEQ ID NO: 1328, SEQ ID NO: 1336 and SEQ ID NO: 1339. In some embodiments the Class 4 peptide comprises a peptide selected from the group consisting of SEQ ID NO: 1309, SEQ ID NO: 1310, SEQ ID NO: 1311 and SEQ ID NO: 1312.

In accordance with some embodiments, a Class 4 peptide is provided wherein a linear amino acid sequence representing the Fc portion of an immunoglobin molecule has been covalently linked to an amino acid side chain of a Class 4 peptide disclosed herein to improve the solubility, stability and/or pharmacokinetics of the glucagon peptide. For example, the amino acid sequence representing the Fc portion of an immunoglobin molecule can be covalently bound to position 11, 12, 15, 16, 19, 21 or 24 of the glucagon peptide of SEQ ID NO: 1307, SEQ ID NO: 1339, or a glucagon analog thereof. In some embodiments the Fc peptide is covalently bound to position 11 or 19 of the Class 4 peptide of SEQ ID NO: 1306, SEQ ID NO: 1307, SEQ ID NO: 1308 or SEQ ID NO: 1336. The Fc portion is usually isolated from IgG, but the Fc peptide fragment from any immunoglobin should function equivalently. In some embodiments the glucagon peptide is selected from the group consisting of SEQ ID NO: 1303, SEQ ID NO: 1304, SEQ ID NO: 1305, SEQ ID NO: 1307 SEQ ID NO: 1308, and SEQ ID NO: 1339, wherein the Fc portion is linked to the corresponding position of 16, 17, 20, 21, 24 or 29 of the native glucagon peptide. In some embodiments the Class 4 peptide comprises a glucagon peptide selected from the group consisting of SEQ ID NO: 1309, SEQ ID NO: 1310, SEQ ID NO: 1311 and SEQ ID NO: 1312, wherein the Fc peptide is bound to the side chain of the amino acid located at position 11, 16 or 19 of SEQ ID NO: 1309, SEQ ID NO: 1310, SEQ ID NO: 1311, respectively, and at both positions 11 and 19 for SEQ ID NO: 1312.

In certain embodiments of the invention, the Class 4 peptide comprises the amino acid sequence of any of SEQ ID NOs: 1362, 1364-1367, and 1371.

Modifications to Improve Solubility

The Class 4 peptides can be further modified to improve the peptide's solubility in aqueous solutions at physiological pH, while, in some aspects retaining a glucagon antagonist activity. Introduction of hydrophilic groups at positions corresponding to positions 1, 16, 17, 20, 21, 24 and 29 of the native peptide, or at the C-terminus, can improve the solubility of the resulting Class 4 peptide in solutions having a physiological pH, while retaining the parent compounds antagonist activity. Therefore, in some embodiments the presently disclosed Class 4 peptides are further modified to comprise one or more hydrophilic groups covalently linked to the side chains of amino acids corresponding to amino acid positions 1, 16, 17, 20, 21, 24 and 29 of the native glucagon peptide or of the N- or C-terminal amino acid. In a further embodiment the side chains of amino acids corresponding to amino acid positions 16 and 24 of the native glucagon peptide are covalently bound to hydrophilic groups, and in some embodiments the hydrophilic group is polyethylene glycol (PEG).

Applicants have also discovered that native glucagon can be modified by introducing charge at its carboxy terminus to enhance the solubility of the peptide while retaining the agonist properties of the peptide. The enhanced solubility allows for the preparation and storage of glucagon solutions at near neutral pH. Formulating glucagon solutions at relatively neutral pHs (e.g. pH of about 6.0 to about 8.0) improves the long term stability of the Class 4 peptides.

Again, applicants anticipate that the Class 4 peptides disclosed herein can be similarly modified to enhance their solubility in aqueous solutions at relatively neutral pH (e.g. pH of about 6.0 to about 8.0) while retaining the antagonist properties of the parent protein. Accordingly, some embodiments of the present invention is directed to a Class 4 peptide of SEQ ID NO: 1339 that has been further modified relative to the native amino acids present at positions 6-29 of the wild type glucagon (SEQ ID NO: 1301) to add charge to the peptide by the substitution of native non-charged amino acids with charged amino acids, or the addition of charged amino acids to the carboxy terminus. In accordance with some embodiments, one to three of the non-charged native amino acids of the Class 4 peptide of SEQ ID NO: 1339 are replaced with a charged amino acid. In some embodiments the charged amino acid is selected from the group consisting of lysine, arginine, histidine, aspartic acid and glutamic acid. More particularly, applicants have discovered that substituting the normally occurring amino acid at corresponding position 28 and/or 29 relative to native glucagon with charged amino acids, and/or the addition of one to two charged amino acids at the carboxy terminus of the Class 4 peptide, enhances the solubility and stability of the Class 4 peptides in aqueous solutions at physiologically relevant pHs (i.e., a pH of about 6.5 to about 7.5). Accordingly, such modifications of the Class 4 peptide disclosed herein are anticipated to have a similar effect on the solubility in aqueous solutions, particularly at a pH ranging from about 5.5 to about 8.0, while retaining the parent peptide's biological activity.

In accordance with some embodiments the Class 4 peptide of SEQ ID NO: 1339 is modified by the substitution of the native amino acid at corresponding position 28 and/or 29 relative to native glucagon with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the Class 4 peptide of SEQ ID NO: 1339 is modified by the substitution of the native amino acid at corresponding position 29 relative to native glucagon with a positively charged amino acid (e.g., lysine, arginine or histidine) and optionally the addition of one or two positively charged amino acid (e.g., lysine, arginine or histidine) on the carboxy terminus of the peptide. In accordance with some embodiments a Class 4 peptide having improved solubility and stability is provided wherein the peptide comprises the amino acid sequence of SEQ ID NO: 1341 with the proviso that at least one amino acids at position, 23, or 24 of SEQ ID NO: 1341 is substituted with an acidic amino acid, and/or an additional acidic amino acid is added at the carboxy terminus of SEQ ID NO: 1341. In some embodiments the acidic amino acids are independently selected from the group consisting of Asp, Glu, cysteic acid and homocysteic acid.

In accordance with some embodiments a Class 4 peptide having improved solubility and stability is provided wherein the antagonist comprises the amino acid sequence of SEQ ID NO: 1341, SEQ ID NO: 1342, SEQ ID NO: 1343 or SEQ ID NO: 1344, wherein at least one of the amino acids at positions 23 or 24 is substituted with a non-native amino acid residue (i.e. at least one amino acid present at position 23 or 24 of the analog is an acidic amino acid different from the amino acid present at the corresponding position in SEQ ID NO: 1307). In accordance with some embodiments a glucagon agonist is provided comprising the sequence of SEQ ID NO: 1341 or 1342 with the proviso that when the amino acid at position 23 is asparagine and the amino acid at position 24 is threonine, the peptide further comprises one to two amino acids, independently selected from the group consisting of Lys, Arg, His, Asp or Glu, added to the carboxy terminus of the Class 4 peptide.

In another embodiment the solubility of the Class 4 peptide of SEQ ID NO: 1342 can be improved by covalently linking a hydrophilic moiety to an amino acid residue at position 11, 12, 15, 16, 19 or 24, and in some embodiments the hydrophilic moiety is linked to an amino acid at position 11, 16 or 19, and in a further embodiment the hydrophilic moiety is linked to amino acid 19. In some embodiments the hydrophilic moiety is a plasma protein or the Fc portion of an immunoglobin, and in an alternative embodiment the hydrophilic moiety is a hydrophilic hydrocarbon chain. In some embodiments the hydrophilic moiety is polyethylene glycol, having a molecular weight selected from the range of about 1,000 to about 5,000 Daltons. In another embodiment the hydrophilic moiety is polyethylene glycol, having a molecular weight of at least about 20,000 Daltons. In some embodiments the polyethylene modified Class 4 peptide comprises the amino acids sequence of SEQ ID NO: 1309, SEQ ID NO: 1310, SEQ ID NO: 1311, SEQ ID NO: 1312, SEQ ID NO: 1343, SEQ ID NO: 1344 or SEQ ID NO: 1345.

Modifications to Improve Stability

The Asp-Ser sequence at position 15-16 of native glucagon has been identified as a uniquely unstable dipeptide that leads to premature chemical cleavage of the native hormone in aqueous buffers. For example, when maintained at 0.01N HCl at 37° C. for 2 weeks, more than 50% of the native glucagon may be cleaved into fragments. The two liberated cleavage peptides 1-15 and 16-29 are devoid of glucagon-like biological activity and thus represent a limitation on the aqueous pre-formulation of glucagon and its related analogs. The selective chemical substitution of the Asp at position 15 of the native glucagon peptide with Glu has been observed to virtually eliminate chemical cleavage of the 15-16 peptide bond.

Accordingly, it is expected that the Class 4 peptides of the present invention can be similarly modified to decrease their susceptibility to premature chemical cleavage in aqueous buffers. In accordance with some embodiments the Class 4 peptides described herein can be further modified to enhance their stability in aqueous solutions by replacing the native aspartic amino acid, located at position 15 of the native glucagon peptide, with an amino acid selected from the group consisting of cysteic acid, glutamic acid, homoglutamic acid and homocysteic acid. In accordance with some embodiments the aspartic acid residue at position 10 of the Class 4 peptide of SEQ ID NO: 1339 can be substituted with an amino acid selected from the group consisting of cysteic acid, glutamic acid, homoglutamic acid and homocysteic acid, and in some embodiments the native aspartic acid at position 10 of SEQ ID NO: 1339 is replaced with glutamic acid. In accordance with some embodiments a Class 4 peptide having improved stability in aqueous solutions is provided wherein the antagonist comprises a sequence selected from the group consisting of SEQ ID NO: 1336, SEQ ID NO: 1340 and SEQ ID NO: 1342. In a further embodiment the Class 4 peptide is amidated.

In accordance with some embodiments, increased stability by way of reduced degradation of the Class 4 peptide described herein may also be achieved by substitution of the serine at position 16 (according to the numbering of native glucagon) with glutamic acid, cysteic acid, homo-glutamic acid, or homo-cysteic acid. In a specific embodiment, the serine at position 16 (according to the native glucagon sequence numbering) is replaced with glutamic acid. In a more specific aspect, the Class 4 peptide comprising such a modification comprises a C-terminal carboxylate and is not amidated.

In accordance with some embodiments, a Class 4 peptide is provided comprising a glucagon peptide selected from the group consisting of SEQ ID NO: 1307, SEQ ID NO: 1336, SEQ ID NO: 1339, SEQ ID NO: 1340, SEQ ID NO: 1341, SEQ ID NO: 1342, SEQ ID NO: 1343 and SEQ ID NO: 1344, further modified by one or more additional amino acid substitutions at positions corresponding to positions 11, 12, 15, 16, 19 and/or 24 of the native glucagon peptide, wherein the amino acid substitutions comprise a substitution with an amino acid having a side chain suitable for crosslinking with hydrophilic moieties, including for example, PEG. The peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. In some embodiments a Class 4 peptide is provided wherein the peptide comprises the sequence of SEQ ID NO: 1307, SEQ ID NO: 1336, SEQ ID NO: 1339, SEQ ID NO: 1340, SEQ ID NO: 1341, SEQ ID NO: 1342, SEQ ID NO: 1343 and SEQ ID NO: 1344, and further comprises a polyethylene glycol chain bound to corresponding position 21 or 24 of the native glucagon peptide. In a further embodiment the C-terminus of the Class 4 peptide is modified to replace the carboxylic acid group with an amide group.

Fusion Peptides and Conjugates

The present disclosure also encompasses Class 4 peptide fusion peptides wherein a second peptide has been fused to the C-terminus of the Class 4 peptide. More particularly, the fusion peptide may comprise a Class 4 peptide peptide of SEQ ID NO: 1344 that further comprises an amino acid sequence of SEQ ID NO: 1319 (GPSSGAPPPS), SEQ ID NO: 1320 (Lys Arg Asn Arg Asn Asn Ile Ala) or SEQ ID NO: 1321 (Lys Arg Asn Arg) linked to the c-terminal amino acid of the Class 4 peptide. In some embodiments the amino acid sequence of SEQ ID NO: 1319 (GPSSGAPPPS) is bound to amino acid 24 of the Class 4 peptide of SEQ ID NO: 1342 through a peptide bond. In another embodiment the fusion peptide comprises a Class 4 peptide peptide of SEQ ID NO: 1307, SEQ ID NO: 1336, SEQ ID NO: 1339, SEQ ID NO: 1340, SEQ ID NO: 1341 or SEQ ID NO: 1343 that further comprises an amino acid sequence of SEQ ID NO: 1319 (GPSSGAPPPS) linked to amino acid 24 of the Class 4 peptide. In another embodiment the fusion peptide comprises a Class 4 peptide peptide of SEQ ID NO: 1307, SEQ ID NO: 1336, SEQ ID NO: 1337, SEQ ID NO: 1338, SEQ ID NO: 1339, SEQ ID NO: 1341 or SEQ ID NO: 1343 that further comprises an amino acid sequence of SEQ ID NO: 1320, SEQ ID NO: 1321 or SEQ ID NO: 1353 linked to amino acid 24 of the Class 4 peptide. In some embodiments the Class 4 peptide fusion peptide comprises a sequence selected from the group consisting of SEQ ID NO: 1346 and SEQ ID NO 1347. In a further embodiment the C-terminus of the fusion peptide is modified to replace the carboxylic acid group with an amide group.

In some embodiments a Class 4 peptide fusion peptide is provided wherein the Class 4 peptide portion of the fusion peptide is selected from the group consisting of SEQ ID NO: 1303, SEQ ID NO: 1304, SEQ ID NO: 1305, SEQ ID NO: 1306, SEQ ID NO: 1307, SEQ ID NO: 1308, SEQ ID NO: 1309, SEQ ID NO: 1311, SEQ ID NO: 1312, SEQ ID NO: 1313, SEQ ID NO: 1314, SEQ ID NO: 1315, SEQ ID NO: 1310, SEQ ID NO: 1316, SEQ ID NO: 1317, SEQ ID NO: 1318 and SEQ ID NO: 1339 and the sequence of SEQ ID NO: 1319 is fused to the carboxy terminus of the Class 4 peptide portion, and wherein the PEG chain, when present, is selected from the range of 500 to 40,000 Daltons. More particularly, in some embodiments the Class 4 peptide segment is selected from the group consisting of SEQ ID NO: 1313, SEQ ID NO: 1314, SEQ ID NO: 1315, SEQ ID NO: 1316, SEQ ID NO: 1346 and SEQ ID NO: 1347 wherein the PEG chain is selected from the range of about 500 to about 5,000 Daltons, and more particularly, in some embodiments the PEG chain is about 1,000 Daltons. In a further embodiment the C-terminus is modified to replace the carboxylic acid group with an amide group.

The Class 4 peptide may further comprise one to two charged amino acids added to the carboxy terminus. In some embodiments, wherein one to two charged amino acids are added to the carboxy terminus of SEQ ID NO: 1344, the amino acids are negatively charged amino acids, including for example glutamic acid and aspartic acid. In some embodiments, the Class 4 peptide comprises the sequence of SEQ ID NO: 1342 wherein at least one of corresponding positions 27 and 28 relative to the native glucagon peptide comprises an amino acid selected from the group consisting of aspartic acid and glutamic acid and wherein SEQ ID NO: 1342 is optionally modified to include an addition one to two negatively charged amino acids added to the carboxy terminus. In some embodiments the negatively charged amino acids are glutamic acid or aspartic acid.

The Class 4 peptides disclosed herein can be combined with other active agents, including for example, insulin, to treat diseases or conditions that are characterized by excessive glucagon activity. In some embodiments, Class 4 peptides that have been modified to be covalently bound to a PEG chain having a molecular weight of greater than 10,000 Daltons can be administered in conjunction with insulin to help to maintain stable blood glucose levels in diabetics. The Class 4 peptides of the present disclosure can be co-administered with insulin as a single composition, simultaneously administered as separate solutions, or alternatively, the insulin and the Class 4 peptide can be administered at different times relative to one another. In some embodiments the composition comprising insulin and the composition comprising the Class 4 peptide are administered within 12 hours of one another. The exact ratio of the Class 4 peptide relative to the administered insulin will be dependent in part on determining the glucagon levels of the patient, and can be determined through routine experimentation.

Dimer Peptides

The present disclosure also encompasses multimers of the modified Class 4 peptides disclosed herein. Two or more of the modified Class 4 peptides can be linked together using standard linking agents and procedures known to those skilled in the art. For example, dimers can be formed between two modified Class 4 peptides through the use of bifunctional thiol crosslinkers and bi-functional amine crosslinkers, particularly for Class 4 peptides that have been substituted (at positions 11, 16 or 19, for example) with cysteine, lysine ornithine, homocysteine or acetyl phenylalanine residues (e.g. SEQ ID NO: 1309, SEQ ID NO: 1310, SEQ ID NO: 1311 and SEQ ID NO: 1312). The dimer can be a homodimer or alternatively can be a heterodimer. In some embodiments the dimer is formed between two Class 4 peptides independently selected from the group consisting of SEQ ID NO: 1308, SEQ ID NO: 1309, SEQ ID NO: 1310, SEQ ID NO: 1311, SEQ ID NO: 1312, SEQ ID NO: 1345, SEQ ID NO: 1346, or SEQ ID NO: 1347, wherein the two peptides are linked to one another via a linker attached to position 11 of each peptide, 16 of each peptide, or position 19 of each peptide or any combination thereof. In some embodiments the linkage is a disulfide linkage between a Cys11 to Cys11 or a Cys19 to Cys19 or a Cys11 to Cys19 residue of the respective Class 4 peptide peptides.

Similarly, a dimer can be formed between two Class 4 peptide peptides independently selected form the group consisting of SEQ ID NO: 1303, SEQ ID NO: 1304, SEQ ID NO: 1305, SEQ ID NO: 1306, SEQ ID NO: 1307, SEQ ID NO: 1308, SEQ ID NO: 1309, SEQ ID NO: 1310, SEQ ID NO: 1311, SEQ ID NO: 1312, SEQ ID NO: 1336, SEQ ID NO: 1337, SEQ ID NO: 1338, SEQ ID NO: 1339 and SEQ ID NO: 1342 wherein the linkage is formed between amino acid positions independently selected from positions 16, 21 and 24 with respect to the native glucagon peptide.

In accordance with some embodiments a Class 4 peptide dimer is provided comprising two Class 4 peptides, each comprising the sequence of SEQ ID NO: 1346, wherein the two antagonists are linked to one another by a disulfide bond through amino acid position 25. In another embodiment a Class 4 peptide dimer is provided comprising two Class 4 peptides, each comprising the sequence of SEQ ID NO: 1347, wherein the two antagonists are linked to one another by a disulfide bond through amino acid position 35. In some embodiments the dimer is formed from Class 4 peptides of SEQ ID NO: 1346 and SEQ ID NO: 1347 wherein the amino acid at position 10 is glutamic acid.

In some embodiments the dimer comprises a homodimer of a Class 4 peptide fusion peptide selected from the group consisting of SEQ ID NO: 1307, SEQ ID NO: 1308, SEQ ID NO: 1336, SEQ ID NO: 1337, SEQ ID NO: 1340, SEQ ID NO: 1339, NO: 1340, SEQ ID NO: 1341, SEQ ID NO: 1342 and pharmaceutically acceptable salts of said Class 4 peptides. In accordance with some embodiments a dimer is provided comprising a first Class 4 peptide bound to a second Class 4 peptide via a linker, wherein the first and second peptides of the dimer are independently selected from the group consisting of SEQ ID NO: 1307, SEQ ID NO: 1308, SEQ ID NO: 1336, SEQ ID NO: 1337, SEQ ID NO: 1339, SEQ ID NO: 1340, SEQ ID NO: 1341, and SEQ ID NO: 1342, and pharmaceutically acceptable salts of said glucagon polypeptides. In another embodiment the first and second Class 4 peptides of the dimer are independently selected from the group consisting of SEQ ID NO: 1307, SEQ ID NO: 1308, SEQ ID NO: 1336 and SEQ ID NO: 1339.

In another embodiment the dimer comprises a homodimer of a Class 4 peptide selected from the group consisting of SEQ ID NO: 1323, SEQ ID NO: 1324, SEQ ID NO: 1325, SEQ ID NO: 1326, SEQ ID NO: 1327, SEQ ID NO: 1328, SEQ ID NO: 1329, SEQ ID NO: 1330, SEQ ID NO: 1331. In another embodiment, a Class 4 peptide dimer is provided wherein the first and second peptides of the dimer comprise an amino acid sequence independently selected from the group consisting of SEQ ID NO: 1323, SEQ ID NO: 1324, SEQ ID NO: 1325, SEQ ID NO: 1326, SEQ ID NO: 1327 and SEQ ID NO: 1328. In another embodiment the dimer comprises a homodimer of a Class 4 peptide selected from the group consisting of SEQ ID NO: 1309, SEQ ID NO: 1311 and SEQ ID NO: 1312, wherein the peptide further comprises a polyethylene glycol chain covalently bound to position 11 or 19 of the glucagon peptide.

The Class 4 glucagon related peptide may comprise the amino acid sequence of any of SEQ ID NOs: 1301-1371, optionally with up to 1, 2, 3, 4, or 5 further modifications that retain glucagon antagonist activity.

Class 5 Glucagon Related Peptides

In certain embodiments, a glucagon related peptide is a class 5 glucagon related peptide (see, e.g., International (PCT) Patent Application Publication No. WO 2009/058734, incorporated herein by reference in its entirety).

All biological sequences referenced in the following section (SEQ ID NOs: 1401-1518) correspond to SEQ ID NOs.: 1-118 in International Patent Application Publication No. WO 2009/058734.

Activity

In certain aspects a class 5 glucagon related peptide (hereafter referred to as a "class 5 peptide") may be a glucagon antagonist/GLP-1 agonist. Glucagon antagonists/GLP-1 agonists are utilized in any setting where the suppression of glucagon agonism is desired while simultaneous stimulation of GLP-1 activity is also desired. For example, glucagon antagonist activity in conjunction with GLP-1 stimulation can be used in the treatment of diabetes where glucagon antagonism has been demonstrated in pre-clinical models of hyperglycemia to yield a lowering of blood glucose and GLP-1 activity is associated with insulin production. Compounds demonstrating GLP-1 activity have also been known to be useful for treating obesity and preventing weight gain.

In certain aspects class 5 peptides are believed to be suitable for any use that has previously been described for other glucagon antagonist/GLP-1 agonists. These two activities have separately been shown to be highly desirable properties for the treatment of the metabolic syndrome, specifically diabetes and obesity. The glucagon antagonist activity is useful in any setting where the suppression of glucagon agonism is desired. The presence of GLP-1 agonism further suppresses the endogenous secretion of glucagon from the pancreas while stimulating insulin synthesis and secretion. The two pharmacological actions serve in a synergistic fashion to normalize metabolic abnormalities. Accordingly, the Class 5 peptides can be used to treat hyperglycemia, or treat other metabolic diseases that result from high blood levels of glucagon or high blood glucose levels. In accordance with some embodiments the patient to be treated using the glucagon antagonist/GLP-1 agonists such as class 5 peptides disclosed herein is a domesticated animal, and in another embodiment the patient to be treated is a human. Studies suggest that lack of glucagon suppression in diabetic patients contributes to postprandial hyperglycemia in part via accelerated glycogenolysis. Analysis of blood glucose during an Oral Glucose Tolerance Test (OGTT), and in the presence or absence of somatostatin-induced glucagon suppression has shown a significant increase in glucose in subjects with higher glucagon levels. Accordingly, a glucagon antagonist/GLP-1 agonists or Class 5 peptides described herein can be used to treating hyperglycemia, and are expected to be useful for treating a variety of types of diabetes including diabetes mellitus type I, diabetes mellitus type II, or gestational diabetes, either insulin-dependent or non-insulin-dependent, and reducing complications of diabetes including nephropathy, retinopathy and vascular disease.

Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

Pharmaceutical compositions comprising class 5 peptides can be formulated and administered to patients using standard pharmauctically acceptable carriers and routes of administration known to those skilled in the art. Accordingly, the present disclosure also encompasses pharmaceutical compositions comprising one or more class 5 peptides disclosed herein in combination with a pharmaceutically acceptable carrier. The pharmaceutical compositions may comprise the class 5 peptides as the sole pharmaceutically active component, or the class 5 peptides can be combined with one or more additional active agents. In accordance with some embodiments a composition is provided comprising a Class 5 peptide and insulin or an insulin analog. Alternatively, a composition is provided for inducing weight loss or preventing weight gain can be provided that comprises the sequence of SEQ ID NO: 1415 or SEQ ID NO: 1451 further comprising the amino acid sequence of SEQ ID NO: 1421 (GPSSGAPPPS) or SEQ ID NO: 1450 linked to amino acid 24 of SEQ ID NO: 1415 or SEQ ID NO: 1451, and an anti-obesity peptide. Suitable anti-obesity peptides include those disclosed in U.S. Pat. Nos. 5,691,309, 6,436,435 or US Patent application 20050176643.

Class 5 Peptide Structure

In accordance with some embodiments a Class 5 peptide is provided comprising a glucagon peptide that has been modified by the deletion of the first 1 to 5 amino acids residues (e.g., first amino acid, first two amino acids, first three amino acids, first four amino acids, first five amino acids) from the N-terminus, and stabilization of the alpha-helix structure in the C-terminal portion of the compound (around amino acid positions 12-29 according to the amino acid numbering of wild type glucagon, SEQ ID NO: 1401), e.g., by the linkage of the side chains of amino acid pairs, selected from positions 12 and 16, 16 and 20, 20 and 24, and 24 and 28 (relative to the native glucagon peptide sequence), to one another through hydrogen-bonding or ionic interactions, such as the formation of salt bridges, or by covalent bonds. Alternatively, stabilization of the alpha-helix around residues 12-29 is achieved through introduction of one or more α,α-disubstituted amino acids at positions that retain the desired activity. In some embodiments, one, two, three, four or more of positions 16, 17, 18, 19, 20, 21, 24 or 29 (according to the amino acid numbering of wild type glucagon) of the Class 5 peptide or analog thereof is substituted with an α,α-disubstituted amino acid. For example, substitution of position 16 (according to the amino acid numbering of wild type glucagon) of a Class 5 peptide or analog thereof with amino iso-butyric acid (Aib) provides a stabilized alpha helix in the absence of a salt bridge or lactam. In some embodiments, one, two, three or more of positions 16, 20, 21 or 24 (according to the amino acid numbering of wild type glucagon) are substituted with Aib.

In accordance with some embodiments, a class 5 peptide is provided wherein the peptide exhibits at least 80% of the maximum agonism achieved by native GLP-1 at the GLP-1 receptor, and exhibits glucagon antagonist activity that reduces the maximum glucagon-induced cAMP production at the glucagon receptor by at least about 50%, as measured by cAMP production in an in vitro assay. In some embodiments, the class 5 peptide exhibits at least 90% of the activity of native GLP-1 at the GLP-1 receptor, and exhibits glucagon antagonist activity, that reduces the maximum glucagon-induced cAMP production at the glucagon receptor by at least about 80%.

In accordance with some embodiments the class 5 peptide comprises a derivative peptide of SEQ ID NO: 1402 wherein the peptide comprises further amino acid substitutions relative to SEQ ID NO: 1402 at one to three amino acid positions selected from positions 1, 2, 4, 5, 6, 7, 8, 9, 10, 11, 12, 13, 14, 15, 16, 19, 22 and 24, and exhibits at least 90% of the activity of native GLP-1 at the GLP-1 receptor, and exhibits glucagon antagonist activity, that reduces the maximum glucagon-induced cAMP production at the glucagon receptor by at least about 80%.

In some embodiments, the alpha-helix structure in the C-terminal portion of the Class 5 peptide (around amino acids 12-29 according to the amino acid numbering of wild type glucagon) is stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). In some embodiments, one, two, three, four or more of positions 16, 17, 18, 19, 20, 21, 24 or 29 (according to the amino acid numbering of wild type glucagon) of the Class 5 peptide or analog thereof is substituted with an α,α-disubstituted amino acid e.g., amino isobutyric acid (Aib). For example, substitution of position 16 (according to the amino acid numbering of wild type glucagon) of a Class 5 peptide or analog thereof with amino iso-butyric acid (Aib) provides a stabilized alpha helix in the absence of a salt bridge or lactam.

In some embodiments the class 5 peptide comprises SEQ ID NO: 1415 or SEQ ID NO: 1451, and more particularly, a sequence selected from the group consisting of SEQ ID NO: 1405, SEQ ID NO: 1406, SEQ ID NO: 1407, SEQ ID NO:

1408, SEQ ID NO: 1409, SEQ ID NO: 1416, SEQ ID NO: 1417, SEQ ID NO: 1418, SEQ ID NO: 1419, SEQ ID NO: 1422, SEQ ID NO: 1423, SEQ ID NO: 1424 and SEQ ID NO: 1425. In further embodiments the class 5 peptide comprises a derivative peptide of SEQ ID NO: 1415 or SEQ ID NO: 1451 wherein the peptide comprises a further amino acid substitution relative to SEQ ID NO: 1415 or SEQ ID NO: 1451 at one to three amino acid positions selected from positions 1, 2, 5, 6, 8, 9, 12, 13 and 14. In some embodiments the substitutions at positions 1, 2, 5, 6, 8, 9, 12, 13 and 14 are conservative amino acid substitutions. In some embodiments the threonine at position 24 of SEQ ID NO: 1405 or SEQ ID NO: 1406 is substituted with glycine.

In accordance with some embodiments the class 5 peptide represents a further modification of the peptide wherein in addition to the N-terminal deletion, the phenylalanine at position 6 of the native glucagon peptide is modified, e.g., to comprise a hydroxyl group in place of the N-terminus amino group. In a further embodiment the natural carboxylic acid of the C-terminal amino acid is replaced with a charge-neutral group, such as an amide or ester.

In accordance with some embodiments, Class 5 peptides have been prepared wherein the first three to five amino acids of native glucagon have been deleted, the amino acid at position 9, relative to the native glucagon peptide, has been substituted with an amino acid selected from the group consisting of glutamic acid, homoglutamic acid, β-homoglutamic acid, a sulfonic acid derivative of cysteine, or an alkylcarboxylate derivative of cysteine having the structure of:

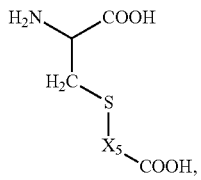

wherein $X_5$ is C1-C4 alkyl, C2-C4 alkenyl, or C2-C4 alkynyl, and the alpha-helix structure in the C-terminal portion of glucagon (around amino acids 12-29 according to the amino acid numbering of wild type glucagon) is stabilized, e.g., via a lactam bridge is formed between the side chains of amino acids 12 and 16 or between amino acids 16 and 20, relative to the native glucagon peptide. Examples of amino acid pairings that are capable of covalently bonding to form a seven-atom linking bridge are detailed through-out this disclosure. In some embodiments, the sulfonic acid derivative of cysteine is cysteic acid or homocysteic acid.

In some embodiments a class 5 is provided comprising an amino acid sequence selected from the group consisting of SEQ ID NO: 1405, SEQ ID NO: 1406, SEQ ID NO: 1407, or SEQ ID NO: 1408, wherein said peptide comprises a lactam ring formed between the side chains of amino acids 7 and 11 for SEQ ID NO: 1405, between 11 and 15 for SEQ ID NO: 1406, between positions 15 and 19 for SEQ ID NO: 1407 and between positions 19 and 24 for SEQ ID NO: 1408, each of said sequences being further modified to comprise a hydrophilic moiety covalently bound to the peptide. More particularly, in some embodiments each of the lactam bearing class 5 peptide are modified by covalent attachment of a polyethylene glycol chain. For example, for a class 5 peptide comprising SEQ ID NO: 1405, the peptide is pegylated at a position selected from the group consisting of 12, 15, 16, 19 and 24; for a class 5 peptide comprising SEQ ID NO: 1406, the peptide is pegylated at a position selected from the group consisting of 12, 16, 19 and 24; for a class 5 peptide comprising SEQ ID NO: 1407, the peptide is pegylated at a position selected from the group consisting of 11, 12, 16 and 24; for class 5 peptide comprising SEQ ID NO: 1408, the peptide is pegylated at a position selected from the group consisting of 11, 12, 15 and 16. In accordance with some embodiments a class 5 peptide comprising SEQ ID NO: 1447 or SEQ ID NO: 1448 is provided wherein the petide is pegylated at a position selected from the group consisting of 12, 16, 19 and 24, relative to the SEQ ID NO: 1447 or SEQ ID NO: 1448 sequence. In a further embodiment the peptide of SEQ ID NO: 1447 or SEQ ID NO: 1448 is further modified by the addition of the sequence of SEQ ID NO: 1421 to the carboxy terminus of the peptide.

As detailed above in certain aspects Class 5 peptides are provided wherein the first five amino acids of native glucagon have been deleted, the amino group of the N-terminal amino acid (phenylalanine) has been replaced with a hydroxyl group (i.e., the first amino acid is phenyl-lactic acid) and the side chains of one or more amino acid pairs selected from positions 12 and 16, 16 and 20, 20 and 24, and 24 and 28 are linked to one another, thus stabilizing the Class 5 peptide alpha helix.

In accordance with some embodiments a class 5 peptide is provided comprising the sequence of SEQ ID NO: 1402 that is modified by a substitution of the serine residue at position 11 of SEQ ID NO: 1402 (position 16 according to the amino acid numbering of native glucagon) with an amino acid selected from the group consisting of glutamic acid, glutamine, homoglutamic acid, homocysteic acid, threonine or glycine. In accordance with some embodiments the serine residue at position 11 of SEQ ID NO: 1402 is substituted with an amino acid selected from the group consisting of glutamic acid, glutamine, homoglutamic acid and homocysteic acid, and in some embodiments the serine residue is substituted with glutamic acid. In accordance with some embodiments the class 5 peptide comprises the sequence of SEQ ID NO: 1438.

In some embodiments a class 5 peptide is provided wherein an intramolecular bridge is formed between two amino acid side chains to stabilize the three dimensional structure of the carboxy terminus of the peptide of SEQ ID NO: 1402. More particularly, the side chains of one or more amino acids selected from amino acid pairs 7 and 11, 11 and 15, 15 and 19 or 19 and 23 of SEQ ID NO: 1402 are linked to one another, thus stabilizing the alpha helix in the C-terminal portion. The two side chains can be linked to one another through hydrogen-bonding, ionic interactions (such as the formation of salt bridges), or by covalent bonds. In accordance with some embodiments the size of the linker is 7-9 atoms, and in some embodiments the size of the linker is 8 atoms. In some embodiments the class 5 peptide is selected from the group consisting of SEQ ID NO: 1405, SEQ ID NO: 1406, SEQ ID NO: 1407 and SEQ ID NO: 1408. In some embodiments the C-terminal amino acid of the class 5 peptide have an amide group substituting for the carboxylic acid group that is present on the native amino acid.

In accordance with some embodiments class 5 peptide is provided wherein the analog comprises an amino acid sequence of SEQ ID NO: 1409. In some embodiments the three dimensional structure of the carboxy terminus of the peptide of SEQ ID NO: 1409 is stabilized by the formation of covalent bonds between the side chains of the peptide. In some embodiments two amino acid side chains are bound to one another to form a lactam ring. The size of the lactam ring can vary depending on the length of the amino acid side chains, and in some embodiments the lactam is formed by linking the side chains of a lysine amino acid to a glutamic acid side chain. In some embodiments the C-terminal amino acid of the class 5 peptides have an amide group substituting for the carboxylic acid group that is present on the native amino acid.

The order of the amide bond in the lactam ring can be reversed (e.g., a lactam ring can be formed between the side chains of a Lys12 and a Glu 16 or alternatively between a Glu 12 and a Lys16). In accordance with some embodiments a glucagon analog of SEQ ID NO: 1409 is provided wherein at least one lactam ring is formed between the side chains of an amino acid pair selected from the group consisting of amino acid pairs 7 and 11, 11 and 15, 15 and 19 or 19 and 23 of SEQ ID NO: 1409. In some embodiments a class 5 peptide is provided wherein the peptide comprises the sequence of SEQ ID NO: 1410, said sequence further comprising an intramolecular lactam bridge formed between amino acid positions 7 and 11, or between amino acid positions 11 and 15, or between amino acid positions 15 and 19 of SEQ ID NO: 1410. In some embodiments a class 5 peptide is provided wherein the peptide comprises the sequence of SEQ ID NO: 1411, said sequence further comprising an intramolecular lactam bridge formed between amino acid positions 7 and 11, or between amino acid positions 11 and 15 of SEQ ID NO: 1411. In some embodiments the class 5 peptide comprises the sequence of SEQ ID NO: 1417.

Additional class 5 peptide are provided comprising derivatives of SEQ ID NO: 1405, wherein the aspartic acid at position 10 of SEQ ID NO: 1405 (position 15 of native glucagon) has been substituted with glutamic acid, an amino acid of the general structure:

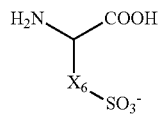

wherein $X_6$ is C1-C3 alkyl, C2-C3 alkene or C2-C3 alkynyl, and in some embodiments $X_6$ is C1-C3 alkyl, and in another embodiment $X_6$ is C2 alkyl. In some embodiments a Class 5 peptide derivative of SEQ ID NO: 1409 is provided wherein position 10 of SEQ ID NO: 1409 (position 15 of native glucagon) is substituted with an amino acid selected from the group consisting of glutamic acid, cysteic acid, homocysteic acid and homoglutamic acid. In a further embodiment position 10 of SEQ ID NO: 1409 is substituted with an amino acid selected from the group consisting of cysteic acid or homocysteic acid. In some embodiments a Class 5 peptide derivative of SEQ ID NO: 1406, SEQ ID NO: 1407 or SEQ ID NO: 1408 is provided wherein position 10 of SEQ ID NO: 1406, SEQ ID NO: 1407 or SEQ ID NO: 1408 is substituted with an amino acid selected from the group consisting of glutamic acid, cysteic acid, homocysteic acid and homoglutamic acid. In some embodiments the C-terminal amino acid of a class 5 peptide have an amide group substituting for the carboxylic acid group that is present on the native amino acid.

In some embodiments an amino acid of class 5 peptide is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, an amino acid of a class 5 peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In accordance with some embodiments the lysine residue corresponding to position 7 of the peptide of SEQ ID NO: 1405 is substituted with arginine and a single lysine substitution is inserted for one of the amino acids corresponding to position 12, 15, 16, 19 and 24 of SEQ ID NO: 1405.

In another embodiment the methionine residue corresponding to position 22 of the class 5 peptides disclosed herein is changed to leucine or norleucine to prevent oxidative degradation of the peptide.

Moreover class 5 peptides, in some aspects, also encompass amino acid substitutions at positions that are known not to be critical to the function of the glucagon analog. In some embodiments the substitutions are conservative amino acid substitutions at one, two or three positions selected from the group consisting of 2, 5, 6, 7, 8, 9, 12, 13, 14, 15, 16, 19, 22, 23 or 24. In some embodiments the amino acids corresponding to positions 16, 17, 20, 21, 24 or 29 of the native glucagon peptide, and more particularly at position 21 and/or 24 relative to native glucagon are substituted with cysteine or lysine, wherein a PEG chain is covalently attached to the substituted cysteine or lysine residue.

In accordance with some embodiments, a class 5 peptide is provided comprising a sequence consisting of SEQ ID NO: 1409, further modified by one or more additional amino acid substitutions at positions corresponding to positions 11, 12, 15, 16, 19 and/or 24 of the peptide (including for example substitution with cysteine), wherein the amino acid substitution comprises an amino acid having a side chain suitable for crosslinking with hydrophilic moieties, including for example, PEG. Native glucagon can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. In some embodiments a Class 5 peptide is provided wherein the peptide comprises the sequence of SEQ ID NO: 1409 and further comprises a polyethylene glycol chain bound to position 16 or 19 of the peptide. In a further embodiment the C-terminus of the glucagon analog is modified to replace the carboxylic acid group with an amide group.

In accordance with some embodiments a class 5 peptide is provided comprising a glucagon analog selected from the group consisting of:

```
                                          (SEQ ID NO: 1439)
R₁-Phe-Thr-Ser-Xaa-Tyr-Ser-Lys-Tyr-Leu-Xaa-Glu-

Arg-Arg-Ala-Gln-Asp-Phe-Val-Gln-Trp-Leu-Xaa-Asn-

Thr-R₂

(SEQ ID NO: 1413)
R₁-Phe-Thr-Ser-Xaa-Tyr-Ser-Lys-Tyr-Leu-Asp-Glu-

Arg-Arg-Ala-Gln-Xaa-Phe-Val-Gln-Trp-Leu-Xaa-Asn-

Thr-R₂,
```

```
                                              (SEQ ID NO: 1414)
R₁-Phe-Thr-Ser-Xaa-Tyr-Ser-Lys-Tyr-Leu-Asp-Glu-

Arg-Arg-Ala-Gln-Asp-Phe-Val-Xaa-Trp-Leu-Xaa-Asn-

Thr-R₂
and
                                              (SEQ ID NO: 1412)
R₁-Phe-Thr-Ser-Xaa-Tyr-Ser-Lys-Tyr-Leu-Asp-Glu- Arg-Arg-Ala-Gln-Xaa-Phe-Val-Xaa-Trp-Leu-Xaa-Asn- Thr-R₂,
``` wherein Xaa at position 4=aspartic acid, glutamic acid, cysteic acid or homocysteic acid, Xaa at position 10=Asp, Glu, cysteic acid, homoglutamic acid and homocysteic acid, Xaa at position 16 is Asp, Cys, Orn, homocysteine or acetyl phenylalanine and the Xaa at position 19 is Gln, Cys, Orn, homocysteine and acetyl phenylalanine, Xaa at position 22=Met, Leu or Nle, $R_1$ is OH or $NH_2$, and $R_2$ is Gly Pro Ser Ser Gly Ala Pro Pro Pro Ser (SEQ ID NO: 1421), Gly Pro Ser Ser Gly Ala Pro Pro Pro Ser Xaa (SEQ ID NO: 1450; wherein Xaa is Cys, Orn, homocystein or acetyl phenylalanine), COOH or $CONH_2$, wherein the peptide is optionally pegylated at position 16 of SEQ ID NO: 1413, position 19 of SEQ ID NO: 1414 and at positions 16 and 19 of SEQ ID NO: 1412. In some embodiments the Thr at position 24 of SEQ ID NOs: 1412-1414 and 1439 is substituted with Gly. In accordance with some embodiments the peptide comprises the sequence of SEQ ID NO: 13 or SEQ ID NO: 1414, wherein $R_1$ is OH. In accordance with some embodiments the peptide comprises the sequence of SEQ ID NO: 1413 or SEQ ID NO: 1414, wherein $R_1$ is OH and $R_2$ is $CONH_2$. In accordance with some embodiments the peptide comprises the sequence of SEQ ID NO: 1413 or SEQ ID NO: 1414, wherein $R_1$ is OH, R2 is $CONH_2$ and the threonine at position 24 is substituted with glycine.

In some embodiments, a class 5 peptide is further modified to comprise one or more amino acids of native GLP-1 by substitution of the native glucagon residue(s) at corresponding amino acid positions. For example, the class 5 peptide may comprise one or more amino acid substitutions at any of positions 2, 3, 17, 18, 21, 23, and 24 (according to the amino acid numbering of native glucagon). In a specific embodiment, the class 5 peptide is modified by one or more of the following amino acid substitutions: Ser2 is replaced with Ala, Gln3 is replaced with Glu, Arg17 is replaced with Gln, Arg at position 18 is replaced with Ala, Asp at position 21 is replaced with Glu, Val at position 23 is replaced with Ile, and Gln at position 24 is replaced with Ala (amino acid positions are in accordance with the native glucagon sequence). In a specific embodiment, the class 5 peptide is modified by replacing Ser2 with Ala and Gln3 with Glu (according to the amino acid numbering of native glucagon). In another specific embodiment, the class 5 peptide is modified with all of the following amino acid substitutions: Arg17 is replaced with Gln, Arg at position 18 is replaced with Ala, Asp at position 21 is replaced with Glu, Val at position 23 is replaced with Ile, and Gln at position 24 is replaced with Ala (amino acid numbering according to native glucagon). In yet another specific embodiment, the class 5 peptide is modified to comprise just Glu at position 21 (according to the numbering of SEQ ID NO: 1401). Accordingly, the class 5 peptide can comprise the amino acid sequence of any of SEQ ID NOs: 1460-1470, 1473-1478, 1480-1488, 1490-1496, 1503, 1504, 1506, and 1514-1518.

Also provided herein is a class 5 peptide or conjugate thereof comprising (1) a stabilized alpha helix through means described herein (e.g., through an intramolecular bridge, or incorporation of one or more alpha, alpha-di-substituted amino acids, or an acidic amino acid at position 16 (according to the numbering of SEQ ID NO:1401), or a combination thereof; (2) a C-terminal amide or ester in place of a C-terminal carboxylate, and (3) a general structure of A-B-C, wherein A is selected from the group consisting of
  (i) phenyl lactic acid (PLA);
  (ii) an oxy derivative of PLA; and
  (iii) a peptide of 2 to 6 amino acids in which two consecutive amino acids of the peptide are linked via an ester or ether bond;
wherein B represents amino acids p to 26 of SEQ ID NO: 1401, wherein p is 3, 4, 5, 6, or 7, optionally comprising one or more amino acid modifications, as described herein, including, for example, any of the modifications described for Class 5 peptides. For instance the one or more modification may be selected from the group consisting of:
  (iv) Asp at position 9 (according to the amino acid numbering of SEQ ID NO: 1401) is substituted with a Glu, a sulfonic acid derivative of Cys, homoglutamic acid, (3-homoglutamic acid, or an alkylcarboxylate derivative of cysteine having the structure of:

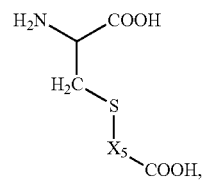

wherein $X_5$ is C1-C4 alkyl, C2-C4 alkenyl, or C2-C4 alkynyl;
  (v) substitution of one or two amino acids at positions 10, 20, and 24, (according to the amino acid numbering of SEQ ID NO: 1401) with an amino acid covalently attached to an acyl or alkyl group via an ester, ether, thioether, amide, or alkyl amine linkage;
  (vi) substitution of one or two amino acids at positions 16, 17, 20, 21, and 24 (according to the amino acid numbering of SEQ ID NO: 1401) with an amino acid selected from the group consisting of: Cys, Lys, ornithine, homocysteine, and acetyl-phenylalanine (Ac-Phe), wherein the amino acid of the group is covalently attached to a hydrophilic moiety;
  (vii) Asp at position 15 (according to the numbering of SEQ ID NO: 1401) is substituted with cysteic acid, glutamic acid, homoglutamic acid, and homocysteic acid;
  (viii) Ser at position 16 (according to the numbering of SEQ ID NO: 1401) is substituted with cysteic acid, glutamic acid, homoglutamic acid, and homocysteic acid;
  (ix) Arg at position 17 is replaced with Gln, Arg at position 18 is replaced with Ala, Asp at position 21 is replaced with Glu, Val at position 23 is replaced with Ile, and Gln at position 24 is replaced with Ala (according to amino acid numbering of SEQ ID NO: 1401);
  (x) Ser at position 16 is replaced with Glu, Gln at position 20 is replaced with Glu, or Gln at position 24 is replaced with Glu (according to the amino acid numbering of SEQ ID NO: 1401);
wherein C (of the general structure of A-B-C) is selected from the group consisting of:
  (vii) X;
  (viii) X-Y;
  (ix) X-Y-Z;
  (x) X-Y-Z-R10;

wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid; wherein R10 is selected from a group consisting of SEQ ID NOs: 1421, 1426, 1427, and 1450.

In a specific aspect, the peptide comprises an oxy derivative of PLA. As used herein "oxy derivative of PLA" refers to a compound comprising a modified structure of PLA in which the hydroxyl group has been replaced with $O-R_{11}$, wherein $R_{11}$ is a chemical moiety. In this regard, the oxy derivative of PLA can be, for example, an ester of PLA or an ether of PLA.

Methods of making oxy derivatives of PLA are known in the art. For example, when the oxy derivative is an ester of PLA, the ester may be formed by upon reaction of the hydroxyl of PLA with a carbonyl bearing a nucleophile. The nucleophile can be any suitable nucleophile, including, but not limited to an amine or hydroxyl. Accordingly, the ester of PLA can comprise the structure of Formula IV:

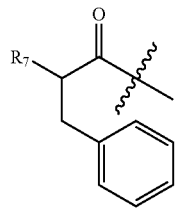

Formula IV wherein $R_7$ is an ester formed upon reaction of the hydroxyl of PLA with a carbonyl bearing a nucleophile.

The carbonyl bearing a nucleophile (which reacts with the hydroxyl of PLA to form an ester) can be, for example, a carboxylic acid, a carboxylic acid derivative, or an activated ester of a carboxylic acid. The carboxylic acid derivative can be, but is not limited to, an acyl chloride, an acid anhydride, an amide, an ester, or a nitrile. The activated ester of a carboxylic acid can be, for example, N-hydroxysuccinimide (NHS), tosylate (Tos), a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yl-oxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

Methods of making ethers from reaction with a hydroxyl group (e.g., the hydroxyl of PLA) also are known in the art. For example, the hydroxyl group of PLA may be reacted with a halogenated alkyl or tosylated alkyl alcohol to form an ether bond.

In a specific embodiment, the chemical moiety bound to PLA via an oxygen-containing bond (e.g., via an ester or ether bond) is a polymer (e.g., a polyalkylene glycol), a carbohydrate, an amino acid, a peptide, or a lipid, e.g., a fatty acid or a steroid.

In a specific embodiment, the chemical moiety is an amino acid, which, optionally, is a part of a peptide, such that Formula IV is a depsipeptide. In this regard, PLA may be at a position other than the N-terminal amino acid residue of the peptide, such that the peptide comprises one or more (e.g., 1, 2, 3, 4, 5, 6, or more) amino acids N-terminal to the PLA residue. For example, the peptide can comprise PLA at position n, wherein n is 2, 3, 4, 5, or 6 of the peptide.

The amino acids N-terminal to the PLA residue may be synthetic or naturally-occurring. In a specific embodiment, the amino acids which are N-terminal PLA are naturally-occurring amino acids. In some embodiments, the amino acids which are N-terminal to PLA are the N-terminal amino acids of native glucagon. For example, the peptide can comprise at the N-terminus the amino acid sequence of any of SEQ ID NOs: 1452-1456, wherein PLA is linked to threonine via an ester bond:

| | |
|---|---|
| His-Ser-Gln-Gly-Thr-PLA | SEQ ID NO: 1452 |
| Ser-Gln-Gly-Thr-PLA | SEQ ID NO: 1453 |
| Gln-Gly-Thr-PLA | SEQ ID NO: 1454 |
| Gly-Thr-PLA | SEQ ID NO: 1455 |
| Thr-PLA | SEQ ID NO: 1456 |

In an alternative embodiment, one or more of the N-terminal amino acids may be substituted with an amino acid other than the amino acid of native glucagon. For example, when the peptide comprises PLA as the amino acid at position 5 or 6, the amino acid at position 1 and/or position 2 may be an amino acid which reduces susceptibility to cleavage by dipeptidyl peptidase IV. More particularly, in some embodiments, position 1 of the peptide is an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist/agonist peptide is an amino acid selected from the group consisting of D-serine, D-alanine, valine, glycine, N-methyl serine, N-methyl alanine, and aminoisobutyric acid (Aib). Also, for example, when the peptide comprises PLA as the amino acid at position 4, 5, or 6, the amino acid at position 3 of the peptide may be glutamic acid, as opposed to the native glutamine residue of native glucagon. In an exemplary embodiment of the invention, the peptide comprises at the N-terminus the amino acid sequence of any of SEQ ID NOs: 1457-1459.

With respect to the peptides comprising a compound of Formula IV, the polymer may be any polymer, provided that it can react with the hydroxyl group of PLA. The polymer may be one that naturally or normally comprises a carbonyl bearing a nucleophile. Alternatively, the polymer may be one which was derivatized to comprise the carbonyl bearing the carbonyl. The polymer may be a derivatized polymer of any of: polyamides, polycarbonates, polyalkylenes and derivatives thereof including, polyalkylene glycols, polyalkylene oxides, polyalkylene terepthalates, polymers of acrylic and methacrylic esters, including poly(methyl methacrylate), poly(ethyl methacrylate), poly(butylmethacrylate), poly (isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

The polymer can be a biodegradable polymer, including a synthetic biodegradable polymer (e.g., polymers of lactic acid and glycolic acid, polyanhydrides, poly(ortho)esters, polyurethanes, poly(butic acid), poly(valeric acid), and poly(lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

The polymer can be a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate).

In some embodiments, the polymer is a water-soluble polymer. Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene co-polymer, polyoxyethyleneglycols, polyethylene oxide, and derivatives, salts, and combinations thereof.

In a specific embodiment, the polymer is a polyalkylene glycol, including, for example, polyethylene glycol (PEG).

The carbohydrate may be any carbohydrate provided that it comprises or is made to comprise a carbonyl with an alpha leaving group. The carbohydrate, for example, may be one which has been derivatized to comprise a carbonyl with an alpha leaving group. In this regard, the carbohydrate may be a derivatized form of a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

The lipid may be any lipid comprising a carbonyl with an alpha leaving group. The lipid, for example, may be one which is derivatized to comprise the carbonyl. In this regard, the lipid, may be a derivative of a fatty acid (e.g., a C4-C30 fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide. In some embodiments, the lipid is an oil, wax, cholesterol, sterol, fat-soluble vitamin, monoglyceride, diglyceride, triglyceride, or a phospholipid.

In some embodiments, $R_7$ has a molecular weight of about 100 kDa or less, e.g., about 90 kDa or less, about 80 kDa or less, about 70 kDa or less, about 60 kDa or less, about 50 kDa or less, about 40 kDa or less. Accordingly, R7 can have a molecular weight of about 35 kDa or less, about 30 kDa or less, about 25 kDa or less, about 20 kDa or less, about 15 kDa or less, about 10 kDa or less, about 5 kDa or less, or about 1 kDa.

In an alternative embodiment, the peptide comprising the general structure of A-B-C comprises, as A, a peptide of 2 to 6 amino acids in which two consecutive amino acids of the peptide of A are linked via an ester or ether bond. The ester or ether bond may be, e.g., between amino acids 2 and 3, 3 and 4, 4 and 5, or 5 and 6. Optionally the peptide of A may be further modified by covalent linkage to another chemical moiety including linkage to a polymer (e.g. a hydrophilic polymer), alkylation, or acylation.

In a specific embodiment, the above-described class 5 peptide comprising PLA is modified to comprise an oxy derivative of PLA, such as, for instance, an ester of PLA or an ether of PLA. For example, the class 5 peptide can comprise the amino acid sequence of any of SEQ ID NOs: 1402, 1405-1420, 1422-1425, 1432-1436, 1438, 1439, 1445, 1446, and 1451, wherein the PLA is linked via an ester or ether bond to an amino acid, peptide, polymer, acyl group, or alkyl group. The amino acid, peptide, polymer, acyl group, or alkyl group may be any of those described herein. In the case that the PLA is linked via an ester bond to an amino acid or peptide, the class 5 peptide may be considered as a depsipeptide.

Also, in another specific embodiment, the above-described class 5 peptide which lacks PLA is modified to comprise at least one ester bond or ether bond between two consecutive amino acids which are N-terminal to the amino acid at position 7 (according to the numbering of native glucagon). In a specific embodiment, the class 5 peptide comprises at least one ester or ether bond between the two consecutive amino acids. In a more specific embodiment, the Class 5 peptide comprises the N-terminal 6 amino acids of SEQ ID NO: 1401 and two consecutive amino acids of the N-terminal 6 amino acids are linked via an ester or ether bond.

The peptide of A may comprise any amino acids, synthetic or naturally occurring, provided that at least two consecutive amino acids are linked via an ester or ether bond. In a specific embodiment, the peptide of A comprises amino acids of native glucagon. The amino acid at position 1 and/or position 2 may be an amino acid which reduces susceptibility to cleavage by dipeptidyl peptidase IV. For instance, the peptide of A can comprise at position 1 an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the peptide of A is an amino acid selected from the group consisting of D-serine, D-alanine, valine, glycine, N-methyl serine, N-methyl alanine, and aminoisobutyric acid (Aib). Also, for example, the amino acid at position 3 of the peptide of A may be glutamic acid, as opposed to the native glutamine residue of native glucagon. Accordingly, the peptide of general structure of A-B-C can comprise an amino acid sequence of:

```
Xaa1-Xaa2-Xaa3-Thr-Gly-Phe;    (SEQ ID NO: 1507)

Xaa2-Xaa3-Thr-Gly-Phe;          (SEQ ID NO: 1508)
or

Xaa3-Thr-Gly-Phe;               (SEQ ID NO: 1509)
``` wherein Xaa1 is selected from a group consisting of: His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine; Xaa2 is selected from a group consisting of: Ser, D-serine, D-alanine, valine, glycine, N-methyl serine, N-methyl alanine, and aminoisobutyric acid (Aib); and Xaa3 is Gln or Glu.

In some embodiments, B is modified by up to three amino acid modifications. For example, B, which represents native amino acid sequence of SEQ ID NO: 1401 is modified by one or more conservative amino acid modifications.

In another embodiment, B comprises one or more amino acid modifications selected from the group consisting of (iv) to (x), as described herein. In a specific embodiment, B comprises one or both of the amino acid modifications (v) and (vi). In a further specific embodiment, B comprises one or a combination of amino acid modifications selected from the group consisting of (iv), (vii), (viii), (ix), and (x), in addition to (v) and (vi).

As described herein, the peptide comprising the general structure A-B-C may comprise one or more charged amino acids at the C-terminus, e.g., as Y and/or Z, as described herein. Alternatively or additionally, the peptide comprising the general structure A-B-C may further comprise one to two charged amino acids C-terminal to Z, when C comprises X-Y-Z. The charged amino acids can be, for example, one of Lys, Arg, His, Asp, and Glu. In a specific embodiment, Y is Asp.

In some embodiments, the peptide comprising the general structure A-B-C comprises a hydrophilic moiety covalently bound to an amino acid residue at position 1, 16, 20, 21, or 24 (according to the amino acid numbering of SEQ ID NO: 1401), or at the N- or C-terminal residue of the peptide comprising the general structure A-B-C. In a specific embodiment, the hydrophilic moiety is attached to a Cys residue of the peptide comprising the general structure A-B-C. In this regard, the amino acid at position 16, 21, 24, or 29 of native glucagon (SEQ ID NO: 1401) may be substituted with a Cys residue. Alternatively, a Cys residue comprising a hydrophilic moiety may be added to the C-terminus of the peptide comprising the general structure A-B-C as position 30 or as position 40, e.g., when the peptide comprising the general structure A-B-C comprises a C-terminal extension (positions according to the amino acid numbering of SEQ ID NO: 1401). Alternatively, the hydrophilic moiety may be attached to the PLA of the peptide comprising the general structure A-B-C via the hydroxyl moiety of PLA. The hydrophilic moiety can be any of those described herein, including, for example, polyethylene glycol.

In a specific aspect, the peptide comprising the general structure A-B-C comprises a stabilized alpha helix by virtue of incorporation of an intramolecular bridge. In some embodiments, the intramolecular bridge is a lactam bridge. The lactam bridge may be between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1401). In a specific embodiment, the amino acids at positions 12 and 16 or at positions 16 and 20 (according to the amino acid numbering of SEQ ID NO: 1401) are linked via a lactam bridge. Other positions of the lactam bridge are contemplated.

Additionally or alternatively, the peptide comprising the general structure A-B-C can comprise an alpha, alpha di-substituted amino acid at, for example, any of positions 16, 20, 21, or 24 (according to the amino acid numbering of SEQ ID NO: 1401). In some embodiments, the alpha, alpha di-substituted amino acid is Aib. In a specific aspect, the Aib is located at position 16 (according to the numbering of SEQ ID NO: 1401).

Alternatively or additionally, the peptide comprising the general structure A-B-C may be modified to comprise an acidic amino acid at position 16 (according to the numbering of SEQ ID NO: 1401), which modification enhances the stability of the alpha helix. The acidic amino acid, in some embodiments, is an amino acid comprising a side chain sulfonic acid or a side chain carboxylic acid. In a more specific embodiment, the acidic amino acid is selected from the group consisting of Glu, Asp, homoglutamic acid, a sulfonic acid derivative of Cys, cysteic acid, homocysteic acid, Asp, and an alkylated derivative of Cys having the structure of

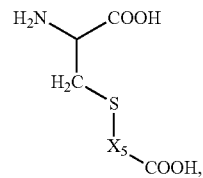

wherein $X_5$ is C1-C4 alkyl, C2-C4 alkenyl, or C2-C4 alkynyl.

In a specific embodiment, the Class 5 peptide may comprise the amino acid sequence of any of SEQ ID NOs: 1460-1470, 1473-1478, 1480-1488, 1490-1496, 1503, 1504, 1506, and 1514-1518, or comprising the amino acid sequence of any of Peptides 2-6 of Table 13, Peptides 1-8 of Table 14, and Peptides 2-6, 8, and 9 of Table 15.

TABLE 13

Lactam, Cex glucagon(6-39) peptides and glucagon antagonist and GLP-1 agonist activity

| | | | GLP-1 EC$_{50}$ (nM) | Glu IC$_{50}$ (nM) |
|---|---|---|---|---|
| 1 | E9, K12, E16 | FTSEYSKYLDERRAQDFVQWLMNTGPSSGAPPPS (SEQ ID NO: 1428) | 1451 | 762 |
| 2 | E9, K12E16(lactam) | FTSEYSKYLDERRAQDFVQWLMNTGPSSGAPPPS (SEQ ID NO: 1429) | 63 | 2008 |
| 3 | E9, E16K20(lactam) | FTSEYSKYLDERRAKDFVQWLMNTGPSSGAPPPS (SEQ ID NO: 1430) | 36 | 42 |
| 4 | D9, K12E16(Lactam) | FTSDYSKYLDERRAQDFVQWLMNTGPSSGAPPPS (SEQ ID NO: 1431) | 118.7 | 828 |
| 5 | [PLA6, E9, K12E16(Lactam) | PLA-TSEYSKYLDERRAQDFVQWLMNTGPSSGAPPPS (SEQ ID NO: 1432) | 6 | 72 |
| 6 | [PLA6, E9, E16K20(Lactam)] | PLA-TSEYSKYLDERRAKDFVQWLMNTGPSSGAPPPS (SEQ ID NO: 1433) | 20 | 20 |

TABLE 14

Lactam glucagon(1-29, 2-29, 4-29 and 6-29) peptides and their glucagon antagonist and GLP-1 agonist activity

| | GLP-1 EC50 (nM) | Glucagon IC50 (nM) |
|---|---|---|
| Glucagon (SEQ ID NO: 1)<br>HSQGTFTSDYSKYLDSRRAQDFVQWLMNT | | 0.2~1.0* |
| GLP-1 (aa 1-30)(SEQ ID NO: 1404)<br>HAEGTFTSDVSSYLEGQAAKEFIAWLVKGR | 0.02~0.1 | |
| 1 [PLA6, D9, E16K20(lactam), D28]G(6-29)(SEQ ID NO: 1460)<br>PLA TSDYSKYLDERRAKDFVQWLMDT | 5~25 | 10~30 |
| 2 [PLA6, D9, K12E16(Lactam), D28]G(6-29)(SEQ ID NO: 1675)<br>PLA TSDYSKYLDERRAQDFVQWLMDT | 177 | 63 |
| 3 [PLA6, D9, E16, K20E24(Lactam), D28]G(6-29)(SEQ ID NO: 1477)<br>PLA TSDYSKYLDERRAKDFVEWLMDT | 239 | 74 |
| 4 [PLA6, D9, E16, E24K28(lactam)]G(6~29)(SEQ ID NO: 1478)<br>PLA TSDYSKYLDERRAQDFVEWLMKT | 289 | 22 |
| 5 [E9, E16K20(lactam), D28]G(4~29)(SEQ ID NO: 1485)<br>GTFTSEYSKYLDERRAKDFVQWLMDT | 151 | 10~30 |
| 6 [E9, E16K20(lactam), D28]G(2~29)(SEQ ID NO: 1486)<br>SQGTFTSEYSKYLDERRAKDFVQWLMDT | 203 | 49 (PA) |
| 7 [A2E3, E16K20(Lactam), D28]G(2~29)(SEQ ID NO: 1463)<br>AEGTFTSEYSKYLDERRAKDFVQWLMDT | 175 | 63 |
| 8 [A2E3, E16K20(Lactam), D28]G(1~29)(SEQ ID NO: 1483)<br>HAEGTFTSEYSKYLDERRAKDFVQWLMDT | 0.2 | 130 (PA) |
| 9 ANK2 (Bayer peptide)(SEQ ID NO: 1437)<br>HSQGTFTSDY ARYLDARRAREFIKWL VRGRG | 0.28 | agonist |

*EC50 at glucagon receptor
(PA = partial antagonist)

TABLE 15

Profile of Mixed Agonist/Antagonist

Glucagon (6-CEX) Analogs

| | | | | |
|---|---|---|---|---|
| 1 | E9, K12, E16 | FTSEYSKYLDERRAQDFVQWLMNTGPSSGAPPPS (SEQ ID NO: 1428) | 1451 | 762 |
| 2 | E9, K12E16(lactam) | FTSEYSKYLDERRAQDFVQWLMNTGPSSGAPPPS (SEQ ID NO: 1429) | 63 | 2008 |
| 3 | E9, E16K20(lactam) | FTSEYSKYLDERRAKDFVQWLMNTGPSSGAPPPS (SEQ ID NO: 1430) | 36 | 42 |
| 4 | D9, K12E20(lactam) | FTSDYSKYLDERRAQDFVQWL1MNTGPSSGAPPPS (SEQ ID NO: 1431) | 18 | 828 |
| 5 | [PLA6, E9, K12E20(lactam) | PLA-TSEYSKYLDERRAQDFVQWLMNTGPSSGAPPPS (SEQ ID NO: 1432) | 6 | 72 |
| 6 | [PLA6, E9, E16K20(Lactam)] | PLA-TSEYSKYLDERRAKDFVQWLMNTGPSSGAPPPS (SEQ ID NO: 1433) | 20 | 20 |

Glucagon $D^9$(6-29) analogs

| | | | GLP-1 EC50 (nM) | Glucagon IC50 (nM) |
|---|---|---|---|---|
| 7 | PLA 6, D9, D28 | PLA-TSDYSKYLDSRRAQDFVQWLMDT (SEQ ID NO: 1434) | ~700 | tbd |
| 8 | PLA6, D9, K12E20(Lactam) | PLA-TSDYSKYLDERRAQDFVQWLMDT (SEQ ID NO: 1475) | 21 | 13 |
| 9 | PLA6, D9, E16K20(lactam) | PLA-TSDYSKYLDERRAKDFVQWLMDT (SEQ ID NO: 1476) | 4 | 6 |

In some embodiments, the peptide comprising the general structure A-B-C is a Class 5 peptide. In a specific embodiment, the peptide exhibits at least about 50% of the maximum agonism achieved by native GLP-1 at the GLP-1 receptor and at least about 50% inhibition of the maximum response achieved by native glucagon at the glucagon receptor. In another specific embodiment, the peptide exhibits at least about 55%, at least about 60%, at least about 70%, at least about 80%, at least about 90%, at least about 95%, or about 100% of the maximum agonism achieved by native GLP-1 at the GLP-1 receptor. Alternatively or additionally, the peptide may exhibit at least about 55%, at least about 60%, at least about 70%, at least about 80%, at least about 90%, at least about 95%, or about 100% inhibition of the maximum response achieved by native glucagon at the glucagon receptor.

In some embodiments, a peptide with Class 5 peptide or conjugate thereof, is provided comprising:

(1) modifications that confer glucagon antagonist activity, including but not limited to:

(a) substitution of the Phe at position 6 with PLA (according to amino acid numbering of wild type glucagon), optionally with deletion of 1 to 5 amino acids from the N-terminus of wild type glucagon; or (b) deletion of 2 to 5 amino acids from the N-terminus of wild type glucagon; optionally with substitution of Asp at position 9 of wild type glucagon with glutamic acid, homoglutamic acid or a sulfonic acid derivative of cysteine (according to amino acid numbering of wild type glucagon); and (2) modifications that confer GLP-1 agonist activity, including but not limited to:

(a) insertion or substitution of α,α-disubstituted amino acid within amino acids 12-29 of wild type glucagon, e.g. at one, two, three, four or more of positions 16, 17, 18, 19, 20, 21, 24 or 29 (according to the amino acid numbering of wild type glucagon); or (b) introduction of an intramolecular bridge within amino acids 12-29 of wild type glucagon, e.g. a salt bridge or a lactam bridge or another type of covalent bond; or (c) substitution of the amino acid at one or more of positions 2, 3, 17, 18, 21, 23, or 24 (according to the amino acid numbering of native glucagon) with the corresponding amino acid of GLP-1, e.g. Ser2 is replaced with Ala, Gln3 is replaced with Glu, Arg17 is replaced with Gln, Arg at position 18 is replaced with Ala, Asp at position 21 is replaced with Glu, Val at position 23 is replaced with Ile, and/or Gln at position 24 is replaced with Ala; or (d) other modifications that stabilize the alpha-helix structure around amino acid positions 12-29 according to the amino acid numbering of wild type glucagon; and (3) other modifications that enhance GLP-1 agonist activity, e.g. a C-terminal amide or ester in place of a C-terminal carboxylate; and optionally (4) one or more of the following modifications:

(a) covalent attachment to a hydrophilic moiety, such as polyethylene glycol, e.g. at the N-terminus, or at position 6, 16, 17, 20, 21, 24, 29, 40 or at the C-terminal amino acid; and/or (b) acylation or alkylation; and optionally (5) one or more of the following additional modifications:

(a) covalent linkage of amino acids, to the N-terminus, e.g. 1-5 amino acids to the N-terminus, optionally via an ester bond to PLA at position 6 (according to the numbering of wild type glucagon), optionally together with modifications at position 1 or 2, e.g. as described herein, that improve resistance to DPP-IV cleavage;

(b) deletion of amino acids at positions 29 and/or 28, and optionally position 27 (according to the numbering of wild type glucagon);

(c) covalent linkage of amino acids to the C-terminus;

(d) non-conservative substitutions, conservative substitutions, additions or deletions while retaining desired activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;

(e) modification of the aspartic acid at position 15, for example, by substitution with glutamic acid, homoglutamic acid, cysteic acid or homocysteic acid, which may reduce degradation; or modification of the serine at position 16, for example, by substitution of threonine, Aib, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;

(f) modification of the methionine at position 27, for example, by substitution with leucine or norleucine, to reduce oxidative degradation;

(g) modification of the Gln at position 20 or 24, e.g. by substitution with Ala or Aib, to reduce degradation that occurs through deamidation of Gln (h) modification of Asp at position 21, e.g. by substitution with Glu, to reduce degradation that occurs through dehydration of Asp to form a cyclic succinimide intermediate followed by isomerization to iso-aspartate;

(j) homodimerization or heterodimerization as described herein; and (k) combinations of the above.

It is understood that any of the modifications within the same class may be combined together and/or modifications of different classes are combined. For example, the modifications of (1)(a) may be combined with (2)(a) and (3); (1)(a) may be combined with (2)(b), e.g. lactam bridge or salt bridge, and (3); (1)(a) may be combined with (2)(c) and (3); (1)(b) may be combined with (2)(a) and (3); (1)(b) may be combined with (2)(b), e.g. lactam bridge or salt bridge, and (3); (1)(b) may be combined with (2)(c) and (3); any of the foregoing may be combined with (4)(a) and/or (4)(b); and any of the foregoing may be combined with any of (5)(a) through (5)(k).

In exemplary embodiments, the α,α-disubstituted amino acid Aib is substituted at one, two, three or all of positions 16, 20, 21, or 24 (according to the amino acid numbering of wild type glucagon).

In exemplary embodiments, the intramolecular bridge is a salt bridge.

In other exemplary embodiments, the intramolecular bridge is a covalent bond, e.g. a lactam bridge. In some embodiments, the lactam bridge is between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1401).

In exemplary embodiments, acylation or alkylation is at position 6, 10, 20 or 24 or the N-terminus or C-terminus (according to the amino acid numbering of wild type glucagon) SEQ ID NO: 1401).

In exemplary embodiments, modifications include:

(i) substitution of Asp at position 15 (according to the numbering of SEQ ID NO: 1401) with cysteic acid, glutamic acid, homoglutamic acid, and homocysteic acid;

(ii) substitution of Ser at position 16 (according to the numbering of SEQ ID NO: 1401) with cysteic acid, glutamic acid, homoglutamic acid, and homocysteic acid;

(iii) substitution of Asn at position 28 with a charged amino acid;

(iv) substitution of Asn at position 28 with a charged amino acid selected from the group consisting of Lys, Arg, His, Asp, Glu, cysteic acid, and homocysteic acid;

(v) substitution at position 28 with Asn, Asp, or Glu;

(vi) substitution at position 28 with Asp;

(vii) substitution at position 28 with Glu;

(viii) substitution of Thr at position 29 with a charged amino acid;

(ix) substitution of Thr at position 29 with a charged amino acid selected from the group consisting of Lys, Arg, His, Asp, Glu, cysteic acid, and homocysteic acid;

(x) substitution at position 29 with Asp, Glu, or Lys;

(xi) substitution at position 29 with Glu;

(xii) insertion of 1-3 charged amino acids after position 29;

(xiii) insertion after position 29 of Glu or Lys;

(xiv) insertion after position 29 of Gly-Lys or Lys-Lys;

or combinations thereof.

Any of the modifications described above which increase GLP-1 receptor agonist activity, glucagon receptor antagonist activity, peptide solubility, and/or peptide stability can be applied individually or in combination.

Modification to Enhance Stability

In accordance with some embodiments the Class 5 peptides disclosed herein can be further modified to include the amino acid sequence of SEQ ID NO: 1421 (GPSSGAPPPS), or SEQ ID NO: 1450, linked to the carboxy terminal amino acid (position 24) of the Class 5 peptide and administered to individuals to induce weight loss or assist in weight maintenance. More particularly, the Class 5 peptide comprises a sequence selected from the group consisting of SEQ ID NO: 1405, SEQ ID NO: 1406, SEQ ID NO: 1407, SEQ ID NO: 1408, SEQ ID NO: 1409, SEQ ID NO: 1412, SEQ ID NO: 1413, SEQ ID NO: 1414, SEQ ID NO: 1416, SEQ ID NO: 1417, SEQ ID NO: 1418, SEQ ID NO: 1419, SEQ ID NO: 1422, SEQ ID NO: 1423, SEQ ID NO: 1424 and SEQ ID NO: 1425 and further comprising the amino acid sequence of SEQ ID NO: 1421 (GPSSGAPPPS), or SEQ ID NO: 1450, linked to the carboxy terminal amino acid (position 24) of the peptide or Class 5 peptide, is used to suppress appetite and inducing weight loss/weight maintenance. In some embodiments the administered peptide or Class 5 peptide comprises a sequence selected from the group consisting of SEQ ID NO: 1416, SEQ ID NO: 1417, SEQ ID NO: 1418 and SEQ ID NO: 1419, further comprising the amino acid sequence of SEQ ID NO: 1421 (GPSSGAPPPS) linked to the carboxy terminal amino acid (position 24) of the Class 5 peptide. In some embodiments the method comprises administering a peptide or Class 5 peptide comprising the sequence of SEQ ID NO: 1445 or SEQ ID NO: 1446.

Accordingly, it is expected that the Class 5 peptides disclosed herein can be similarly modified to decrease their susceptibility to premature chemical cleavage in aqueous buffers. In accordance with some embodiments the Class 5 peptides described herein can be further modified to enhance their stability in aqueous solutions by replacing the native aspartic amino acid, located at corresponding position 15 of native glucagon, with an amino acid selected from the group consisting of cysteic acid, glutamic acid, homoglutamic acid and homocysteic acid. In accordance with some embodiments the aspartic acid residue at position 10 of class 5 peptide of SEQ ID NO: 1405, SEQ ID NO: 1406, SEQ ID NO: 1407 or SEQ ID NO: 1408 can be substituted with an amino acid selected from the group consisting of cysteic acid, glutamic acid, homoglutamic acid and homocysteic acid, and in some embodiments the native aspartic acid at position 10 of SEQ ID NO: 1405, SEQ ID NO: 1406, SEQ ID NO: 1407 or SEQ ID NO: 1408 is replaced with glutamic acid. In accordance with some embodiments a class 5 peptide having improved stability in aqueous solutions is provided wherein the antagonist comprises a modified sequence of SEQ ID NO: 1409, wherein the modification comprises substitution of the Asp at position 10 of SEQ ID NO: 1409 with Glu. In some embodiments a class 5 peptide is provided comprising a sequence selected form the group consisting of SEQ ID NO: 1422, SEQ ID NO: 1423, SEQ ID NO: 1424 and SEQ ID NO: 1425. In some embodiments the class 5 peptide is amidated.

The Asp-Ser sequence at position 15-16 of native glucagon has been identified as a uniquely unstable dipeptide that leads to premature chemical cleavage of the native hormone in aqueous buffers. For example, when maintained at 0.01N HCl at 37° C. for 2 weeks, more than 50% of the native glucagon may be cleaved into fragments. The two liberated cleavage peptides 1-15 and 16-29 are devoid of glucagon-like biological activity and thus represent a limitation on the aqueous pre-formulation of glucagon and its related analogs. The selective chemical substitution of the Asp at position 15 of native glucagon with Glu has been observed to virtually eliminate chemical cleavage of the 15-16 peptide bond.

In yet further exemplary embodiments, any of the foregoing compounds can be further modified to improve stability by modifying the amino acid corresponding to position 15 or 16 of native glucagon, to reduce degradation of the peptide over time, especially in acidic or alkaline buffers.

Modification to Enhance Solubility

The class 5 peptide can be further modified to improve the peptide's solubility in aqueous solutions at physiological pH, in certain aspects, while retaining the glucagon antagonist and GLP-1 agonist activity. Introduction of hydrophilic groups at positions corresponding to positions 12, 15, 16, 19 and 24 of the peptide of SEQ ID NO: 1405, or at positions 12, 16, 19 or 24 of the peptide of SEQ ID NO: 1406 can improve the solubility of the resulting peptides in solutions having a physiological pH, while retaining the parent compounds glucagon antagonist and GLP agonist activity. Therefore, in some embodiments the presently disclosed class 5 peptide that are further modified to comprise one or more hydrophilic groups covalently linked to the side chains of amino acids corresponding to amino acid positions 12, 15, 16, 19 and 24 of the peptide of SEQ ID NO: 1405 or SEQ ID NO: 1406. In a further embodiment the side chains of amino acids corresponding to amino acid positions 16 and 19 of SEQ ID NO: 1405 or SEQ ID NO: 1406 are covalently bound to hydrophilic groups, and in some embodiments the hydrophilic group is polyethylene glycol (PEG).

Class 5 glucagon related peptides can be modified by introducing charge at its carboxy terminus to enhance the solubility of the peptide while retaining the agonist properties of the peptide. The enhanced solubility allows for the preparation and storage of glucagon solutions at near neutral pH. Formulating glucagon solutions at relatively neutral pHs (e.g. pH of about 6.0 to about 8.0) improves the long term stability of the Class 5 peptides.

Applicants anticipate that class 5 peptides disclosed herein can be similarly modified to enhance their solubility in aqueous solutions at relatively neutral pH (e.g. pH of about 6.0 to about 8.0), in some cases, while retaining a glucagon antagonist and GLP-1 activity. Accordingly, some embodiments is directed to a glucagon antagonist/GLP-1 of SEQ ID NO: 1405, SEQ ID NO: 1406, SEQ ID NO: 1407 or SEQ ID NO: 1408 that has been further modified relative to the native amino acids present at positions 6-29 of the wild type glucagon (SEQ ID NO: 1401) to add charge to the peptide by the substitution of native non-charged amino acids with charged amino acids, or the addition of charged amino acids to the carboxy terminus. In accordance with some embodiments, one to three of the non-charged native amino acids of the class 5 peptides disclosed herein are replaced with a charged amino acid. In some embodiments the charged amino acid is selected from the group consisting of lysine, arginine, histidine, aspartic acid and glutamic acid. More particularly, applicants have discovered that substituting the normally occurring amino acid corresponding to position 28 and/or 29 (relative to native glucagon) with charged amino acids, and/or the addition of one to two charged amino acids at the carboxy terminus of the peptide, enhances the solubility and stability of the Class 5 peptide in aqueous solutions at physiologically relevant pHs (i.e., a pH of about 6.5 to about 7.5). Accordingly such modifications of class 5 peptides are anticipated to have a similar effect on the solubility in aqueous solutions, particularly at a pH ranging from about 5.5 to about 8.0, while retaining the parent peptides biological activity.

In accordance with some embodiments the class 5 peptide of SEQ ID NO: 1405, SEQ ID NO: 1406, SEQ ID NO: 1407 or SEQ ID NO: 1408 is modified by the substitution of the native amino acid at position 23 and/or 24 of those sequences with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment a class 5 peptide comprising SEQ ID NO: 1405, SEQ ID NO: 1406, SEQ ID NO: 1407 or SEQ ID NO: 1408 is modified by the substitution of the native amino acid at position 24 of SEQ ID NO: 1405, SEQ ID NO: 1406, SEQ ID NO: 1407 or SEQ ID NO: 1408 with a positively charged amino acid (e.g., lysine, arginine or histidine) and optionally the addition of one or two positively charged amino acid (e.g., lysine, arginine or histidine) on the carboxy terminus of the peptide. In accordance with some embodiments a class 5 peptide having improved solubility and stability is provided wherein the analog comprises the amino acid sequence of SEQ ID NO: 1415 or SEQ ID NO: 1451 with the proviso that at least one amino acids at position, 23, or 24 of SEQ ID NO: 1415 or SEQ ID NO: 1451 is substituted with an acidic amino acid and/or an additional acidic amino acid added at the carboxy terminus of SEQ ID NO: 1415 or SEQ ID NO: 1451. In some embodiments the acidic amino acids are independently selected from the group consisting of Asp, Glu, cysteic acid and homocysteic acid.

In accordance with some embodiments a class 5 peptide having improved solubility and stability is provided wherein the antagonist comprises the amino acid sequence of SEQ ID NO: 1416, SEQ ID NO: 1417, SEQ ID NO: 1418 or SEQ ID NO: 1419. In accordance with some embodiments a glucagon agonist is provided comprising the sequence of SEQ ID NO: 1416 or SEQ ID NO: 1417. In some embodiments the class 5 peptide comprises the sequence of SEQ ID NO: 1420.

In accordance with some embodiments a class 5 peptide is provided comprising the sequence of SEQ ID NO: 1415 or SEQ ID NO: 1451. In some embodiments, position 4 of SEQ ID NO: 1415 or SEQ ID NO: 1451 is aspartic acid, glutamic acid, homoglutamic acid, cysteic acid or homocysteic acid, and in some embodiments position 4 is aspartic acid, glutamic acid, cysteic acid or homocysteic acid, and in a further embodiment position 4 of SEQ ID NO: 1415 or SEQ ID NO: 1451 is aspartic acid or glutamic acid, and in some embodiments position 4 of SEQ ID NO: 1415 or SEQ ID NO: 1451 is aspartic acid. In some embodiments a class 5 peptide is provided comprising the sequence of SEQ ID NO: 1415 or SEQ ID NO: 1451 wherein position 4 of SEQ ID NO: 1415 is aspartic acid and position 10 of SEQ ID NO: 1415 is glutamic acid. In a further embodiment the C-terminal amino acid of SEQ ID NO: 1415 or SEQ ID NO: 1451 is modified to replace the native carboxylic acid group with a charge-neutral group, such as an amide or ester.

Class 5 Peptide Fusions

In a further embodiment, the carboxy terminal amino acid of the Class 5 peptide described herein is covalently bound to a second peptide comprising a sequence selected from the group consisting of SEQ ID NOs: 1421, 1426, 1427, and 1450. For example, in some embodiments, the Class 5 peptide of SEQ ID NO: 1415, SEQ ID NO: 1451, SEQ ID NO: 1405, SEQ ID NO: 1406, SEQ ID NO: 1407, SEQ ID NO: 1408, SEQ ID NO: 1412, SEQ ID NO: 1413, SEQ ID NO: 1414, SEQ ID NO: 1416, SEQ ID NO: 1417, SEQ ID NO: 1418, SEQ ID NO: 1419, SEQ ID NO: 1422, SEQ ID NO: 1423, SEQ ID NO: 1424 and SEQ ID NO: 1425 is covalently bound to a second peptide comprising a sequence selected from the group consisting of SEQ ID NO: 1421 (GPSSGAPPPS), SEQ ID NO: 1426 (KRNRNNIA), SEQ ID NO: 1427 (KRNR) and SEQ ID NO: 1450 (GPSSGAPPPSX).

In some embodiments a class 5 peptide dimer is provided comprising two sequences independently selected from the group consisting of SEQ ID NO: 1405, SEQ ID NO: 1406, SEQ ID NO: 1407, SEQ ID NO: 1408, SEQ ID NO: 1409, SEQ ID NO: 1422, SEQ ID NO: 1423, SEQ ID NO: 1424 and SEQ ID NO: 1425 that further comprises an amino acid sequence of SEQ ID NO: 1421 (GPSSGAPPPS) linked to the carboxy terminal amino acid of the class 5 peptide.

In some embodiments, the class 5 peptide is further modified by truncation or deletion of one or two amino acids of the C-terminus of the peptide (i.e., truncation of the amino acid at position 29 or at positions 28 and 29 of native glucagon). Preferably truncation does not effect activity (e.g., glucagon antagonism/GLP-1 agonism) of a class 5 peptide.

Class 5 Peptide Conjugates

Conjugates of Class 5 peptides are also provided, in which the glucagon peptide is linked, optionally via covalent bonding and optionally via a linker, to a conjugate moiety.

In those embodiments wherein the class 5 peptide comprises a polyethylene glycol chain, the polyethylene glycol chain may be in the form of a straight chain or it may be branched. In accordance with some embodiments the polyethylene glycol chain has an average molecular weight selected from the range of about 500 to about 10,000 Daltons. In some embodiments the polyethylene glycol chain has an average molecular weight selected from the range of about 1,000 to about 5,000 Daltons. In some embodiments the polyethylene glycol chain has an average molecular weight selected from the range of about 1,000 to about 5,000 Daltons. In some embodiments the polyethylene glycol chain has an average molecular weight selected of about 1,000 to about 2,000 Daltons. In some embodiments the polyethylene glycol chain has an average molecular weight of about 1,000 Daltons.

In some embodiments the pegylated class 5 peptide comprises a peptide consisting of the sequence of SEQ ID NO: 1415 or SEQ ID NO: 1451 wherein the polyethylene glycol chain is linked to an amino acid selected from positions 11, 12, 15, 16, 19 and 24 of SEQ ID NO: 1415 or SEQ ID NO: 1451, and the molecular weight of the PEG chain is about 1,000 to about 5,000 Daltons. In some embodiments the pegylated class 5 peptide comprises a peptide consisting of the sequence of SEQ ID NO: 1415 or SEQ ID NO: 1451 wherein the polyethylene glycol chain is linked to the amino acid at position 16 or 19 of SEQ ID NO: 1415 or SEQ ID NO: 1451, and the molecular weight of the PEG chain is about 1,000 to about 5,000 Daltons. In a further embodiment the modified class 5 peptide comprises two or more polyethylene glycol chains covalently bound to the peptide wherein the total molecular weight of the glucagon chains is about 1,000 to about 5,000 Daltons. In some embodiments the class 5 peptide comprises the sequence of SEQ ID NO: 1415 or SEQ ID NO: 1451 wherein a polyethylene glycol chain is linked to the amino acid at positions 16 and 19 of SEQ ID NO: 1415 or SEQ ID NO: 1451 and the combined molecular weight of the two PEG chains is about 1,000 to about 5,000 Daltons.

The class 5 glucagon related peptide may comprise the amino acid sequence of any of SEQ ID NOs: 1401-1518, optionally with up to 1, 2, 3, 4, or 5 further modifications that retain glucagon antagonist and GLP-1 agonist activity.

The Linking Group (L)

As described herein, the present disclosures provide glucagon superfamily peptides conjugated with GPCR ligands having the formula Q-L-Y, wherein L is a linking group or a chemical bond. In some embodiments, L is stable in vivo. In some embodiments, L is hydrolyzable in vivo. In some embodiments, L is metastable in vivo.

Q and Y can be linked together through L using standard linking agents and procedures known to those skilled in the art. In some aspects, Q and Y are fused directly and L is a bond. In other aspects, Q and Y are fused through a linking group L. For example, in some embodiments, Q and Y are linked together via a peptide bond, optionally through a peptide or amino acid spacer. In some embodiments, Q and Y are linked together through chemical conjugation, optionally through a linking group (L). In some embodiments, L is directly conjugated to each of Q and Y.

Chemical conjugation can occur by reacting a nucleophilic reactive group of one compound to an electrophilic reactive group of another compound. In some embodiments when L is a bond, Q is conjugated to Y either by reacting a nucleophilic reactive moiety on Q with an electrophilic reactive moiety on Y, or by reacting an electrophilic reactive moiety on Q with a nucleophilic reactive moiety on Y. In embodiments when L is a group that links Q and Y together, Q and/or Y can be conjugated to L either by reacting a nucleophilic reactive moiety on Q and/or Y with an electrophilic reactive moiety on L, or by reacting an electrophilic reactive moiety on Q and/or Y with a nucleophilic reactive moiety on L. Nonlimiting examples of nucleophilic reactive groups include amino, thiol, and hydroxyl. Nonlimiting examples of electrophilic reactive groups include carboxyl, acyl chloride, anhydride, ester, succinimide ester, alkyl halide, sulfonate ester, maleimido, haloacetyl, and isocyanate. In embodiments where Q and Y are conjugated together by reacting a carboxylic acid with an amine, an activating agent can be used to form an activated ester of the carboxylic acid.

The activated ester of the carboxylic acid can be, for example, N-hydroxysuccinimide (NHS), tosylate (Tos), mesylate, triflate, a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yl-oxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

In some embodiments, Q comprises a nucleophilic reactive group (e.g. the amino group, thiol group, or hydroxyl group of the side chain of lysine, cysteine or serine) that is capable of conjugating to an electrophilic reactive group on Y or L. In some embodiments, Q comprises an electrophilic reactive group (e.g. the carboxylate group of the side chain of Asp or Glu) that is capable of conjugating to a nucleophilic reactive group on Y or L. In some embodiments, Q is chemically modified to comprise a reactive group that is capable of conjugating directly to Y or to L. In some embodiments, Q is modified at the C-terminal to comprise a natural or nonnatural amino acid with a nucleophilic side chain, such as an amino acid represented by Formula I, Formula II, or Formula III, as previously described herein (see Acylation and alkylation). In exemplary embodiments, the C-terminal amino acid of Q is selected from the group consisting of lysine, ornithine, serine, cysteine, and homocysteine. For example, the C-terminal amino acid of Q can be modified to comprise a lysine residue. In some embodiments, Q is modified at the C-terminal amino acid to comprise a natural or nonnatural amino acid with an electrophilic side chain such as, for example, Asp and Glu. In some embodiments, an internal amino acid of Q is substituted with a natural or nonnatural amino acid having a nucleophilic side chain, such as an amino acid represented by Formula I, Formula II, or Formula III, as previously described herein (see Acylation and alkylation). In exemplary embodiments, the internal amino acid of Q that is substituted is selected from the group consisting of lysine, ornithine, serine, cysteine, and homocysteine. For example, an internal amino acid of Q can be substituted with a lysine residue. In some embodiments, an internal amino acid of Q is substituted with a natural or nonnatural amino acid with an electrophilic side chain, such as, for example, Asp and Glu.

In some embodiments, Y comprises a reactive group that is capable of conjugating directly to Q or to L. In some embodiments, Y comprises a nucleophilic reactive group (e.g. amine, thiol, hydroxyl) that is capable of conjugating to an electrophilic reactive group on Q or L. In some embodiments, Y comprises electrophilic reactive group (e.g. carboxyl group, activated form of a carboxyl group, compound with a leaving group) that is capable of conjugating to a nucleophilic reactive group on Q or L. In some embodiments, Y is chemically modified to comprise either a nucleophilic reactive group that is capable of conjugating to an electrophilic reactive group on Q or L. In some embodiments, Y is chemically modified to comprise an electrophilic reactive group that is capable of conjugating to a nucleophilic reactive group on Q or L.

In some embodiments, conjugation can be carried out through organosilanes, e.g., aminosilane treated with glutaraldehyde; carbonyldiimidazole (CDI) activation of silanol groups; or utilization of dendrimers. A variety of dendrimers are known in the art and include poly (amidoamine) (PAMAM) dendrimers, which are synthesized by the divergent method starting from ammonia or ethylenediamine initiator core reagents; a sub-class of PAMAM dendrimers based on a tris-aminoethylene-imine core; radially layered poly(amidoamine-organosilicon) dendrimers (PAMAMOS), which are inverted unimolecular micelles that consist of hydrophilic, nucleophilic polyamidoamine (PAMAM) interiors and hydrophobic organosilicon (OS) exteriors; Poly (Propylene Imine) (PPI) dendrimers, which are generally poly-alkyl amines having primary amines as end groups, while the dendrimer interior consists of numerous of tertiary tris-propylene amines; Poly (Propylene Amine) (POPAM) dendrimers; Diaminobutane (DAB) dendrimers; amphiphilic dendrimers; micellar dendrimers which are unimolecular micelles of water soluble hyper branched polyphenylenes; polylysine dendrimers; and dendrimers based on poly-benzyl ether hyper branched skeleton.

In some embodiments, conjugation can be carried out through olefin metathesis. In some embodiments, Y and Q, Y and L, or Q and L both comprise an alkene or alkyne moiety that is capable of undergoing metathesis. In some embodiments a suitable catalyst (e.g. copper, ruthenium) is used to accelerate the metathesis reaction. Suitable methods of performing olefin metathesis reactions are described in the art. See, for example, Schafmeister et al., *J. Am. Chem. Soc.* 122: 5891-5892 (2000), Walensky et al., *Science* 305: 1466-1470 (2004), and Blackwell et al., *Angew. Chem., Int. Ed.* 37: 3281-3284 (1998).

In some embodiments, conjugation can be carried out using click chemistry. A "click reaction" is wide in scope and easy to perform, uses only readily available reagents, and is insensitive to oxygen and water. In some embodiments, the click reaction is a cycloaddition reaction between an alkynyl group and an azido group to form a triazolyl group. In some embodiments, the click reaction uses a copper or ruthenium catalyst. Suitable methods of performing click reactions are described in the art. See, for example, Kolb et al., *Drug Discovery Today* 8:1128 (2003); Kolb et al., *Angew. Chem. Int. Ed.* 40:2004 (2001); Rostovtsev et al., *Angew. Chem. Int. Ed.* 41:2596 (2002); Tornoe et al., *J. Org. Chem.* 67:3057 (2002); Manetsch et al., *J. Am. Chem. Soc.* 126:12809 (2004); Lewis et al., *Angew. Chem. Int. Ed.* 41:1053 (2002); Speers, *J. Am. Chem. Soc.* 125:4686 (2003); Chan et al. *Org. Lett.* 6:2853 (2004); Zhang et al., *J. Am. Chem. Soc.* 127:15998 (2005); and Waser et al., *J. Am. Chem. Soc.* 127:8294 (2005).

Indirect conjugation via high affinity specific binding partners, e.g. streptavidin/biotin or avidin/biotin or lectin/carbohydrate is also contemplated.

Chemical Modification of Q and/or Y

In some embodiments, Q and/or Y are functionalized to comprise a nucleophilic reactive group or an electrophilic reactive group with an organic derivatizing agent. This derivatizing agent is capable of reacting with selected side chains or the N- or C-terminal residues of targeted amino acids on Q and functional groups on Y. Reactive groups on Q and/or Y include, e.g., aldehyde, amino, ester, thiol, α-haloacetyl, maleimido or hydrazino group. Derivatizing agents include, for example, maleimidobenzoyl sulfosuccinimide ester (conjugation through cysteine residues), N-hydroxysuccinimide (through lysine residues), glutaraldehyde, succinic anhydride or other agents known in the art. Alternatively, Q and/or Y can be linked to each other indirectly through intermediate carriers, such as polysaccharide or polypeptide carriers. Examples of polysaccharide carriers include aminodextran. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, alpha-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysinyl and amino-terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate, pyridoxal phosphate, pyridoxal, chloroborohydride, trinitrobenzenesulfonic acid, O-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin.

Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl side groups (aspartyl or glutamyl) are selectively modified by reaction with carbodiimides (R—N=C=N—R'), where R and R' are different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Other modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)), deamidation of asparagine or glutamine, acetylation of the N-terminal amine, and/or amidation or esterification of the C-terminal carboxylic acid group.

Another type of covalent modification involves chemically or enzymatically coupling glycosides to the peptide. Sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of tyrosine, or tryptophan, or (f) the amide group of glutamine. These methods are described in WO87/05330 published 11 Sep. 1987, and in Aplin and Wriston, CRC Crit. Rev. Biochem., pp. 259-306 (1981).

Structure of L

In some embodiments, L is a bond. In these embodiments, Q and Y are conjugated together by reacting a nucleophilic reactive moiety on Q with and electrophilic reactive moiety on Y. In alternative embodiments, Q and Y are conjugated together by reacting an electrophilic reactive moiety on Q with a nucleophilic moiety on Y. In exemplary embodiments, L is an amide bond that forms upon reaction of an amine on Q (e.g. an ε-amine of a lysine residue) with a carboxyl group on Y. In alternative embodiments, Q and or Y are derivatized with a derivatizing agent before conjugation.

In some embodiments, L is a linking group. In some embodiments, L is a bifunctional linker and comprises only two reactive groups before conjugation to Q and Y. In embodiments where both Q and Y have electrophilic reactive groups, L comprises two of the same or two different nucleophilic groups (e.g. amine, hydroxyl, thiol) before conjugation to Q and Y. In embodiments where both Q and Y have nucleophilic reactive groups, L comprises two of the same or two different electrophilic groups (e.g. carboxyl group, activated form of a carboxyl group, compound with a leaving group) before conjugation to Q and Y. In embodiments where one of Q or Y has a nucleophilic reactive group and the other of Q or Y has an electrophilic reactive group, L comprises one nucleophilic reactive group and one electrophilic group before conjugation to Q and Y.

L can be any molecule with at least two reactive groups (before conjugation to Q and Y) capable of reacting with each of Q and Y. In some embodiments L has only two reactive groups and is bifunctional. L (before conjugation to the peptides) can be represented by Formula VI:

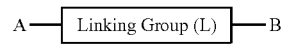

wherein A and B are independently nucleophilic or electrophilic reactive groups. In some embodiments A and B are either both nucleophilic groups or both electrophilic groups. In some embodiments one of A or B is a nucleophilic group and the other of A or B is an electrophilic group. Nonlimiting combinations of A and B are shown below.

| Both Nucleophilic | | Both Electrophilic | | Nucleophilic/Electrophilic | |
|---|---|---|---|---|---|
| A | B | A | B | A | B |
| amino | Amino | carboxyl | carboxyl | amino | carboxyl |
| amino | Thiol | carboxyl | acyl chloride | amino | acyl chloride |
| amino | hydroxyl | carboxyl | anhydride | amino | anhydride |
| thiol | Amino | carboxyl | Ester | amino | ester |
| thiol | Thiol | carboxyl | NHS | amino | NHS |
| thiol | hydroxyl | carboxyl | Halogen | amino | halogen |
| hydroxyl | Amino | carboxyl | sulfonate ester | amino | sulfonate ester |
| hydroxyl | Thiol | carboxyl | maleimido | amino | maleimido |
| hydroxyl | hydroxyl | carboxyl | haloacetyl | amino | haloacetyl |
| | | carboxyl | isocyanate | amino | isocyanate |
| | | acyl chloride | carboxyl | thiol | carboxyl |
| | | acyl chloride | acyl chloride | thiol | acyl chloride |
| | | acyl chloride | anhydride | thiol | anhydride |
| | | acyl chloride | Ester | thiol | ester |
| | | acyl chloride | NHS | thiol | NHS |
| | | acyl chloride | Halogen | thiol | halogen |
| | | acyl chloride | sulfonate ester | thiol | sulfonate ester |

-continued

| Both Nucleophilic | | Both Electrophilic | | Nucleophilic/Electrophilic | |
|---|---|---|---|---|---|
| A | B | A | B | A | B |
| | | acyl chloride | maleimido | thiol | maleimido |
| | | acyl chloride | haloacetyl | thiol | haloacetyl |
| | | acyl chloride | isocyanate | thiol | isocyanate |
| | | anhydride | carboxyl | hydroxyl | carboxyl |
| | | anhydride | acyl chloride | hydroxyl | acyl chloride |
| | | anhydride | anhydride | hydroxyl | anhydride |
| | | anhydride | Ester | hydroxyl | ester |
| | | anhydride | NHS | hydroxyl | NHS |
| | | anhydride | Halogen | hydroxyl | halogen |
| | | anhydride | sulfonate ester | hydroxyl | sulfonate ester |
| | | anhydride | maleimido | hydroxyl | maleimido |
| | | anhydride | haloacetyl | hydroxyl | haloacetyl |
| | | anhydride | isocyanate | hydroxyl | isocyanate |
| | | ester | carboxyl | | |
| | | ester | acyl chloride | | |
| | | ester | anhydride | | |
| | | ester | Ester | | |
| | | ester | NHS | | |
| | | ester | Halogen | | |
| | | ester | sulfonate ester | | |
| | | ester | maleimido | | |
| | | ester | haloacetyl | | |
| | | ester | isocyanate | | |
| | | NHS | carboxyl | | |
| | | NHS | acyl chloride | | |
| | | NHS | anhydride | | |
| | | NHS | Ester | | |
| | | NHS | NHS | | |
| | | NHS | Halogen | | |
| | | NHS | sulfonate ester | | |
| | | NHS | maleimido | | |
| | | NHS | haloacetyl | | |
| | | NHS | isocyanate | | |
| | | halogen | carboxyl | | |
| | | halogen | acyl chloride | | |
| | | halogen | anhydride | | |
| | | halogen | Ester | | |
| | | halogen | NHS | | |
| | | halogen | Halogen | | |
| | | halogen | sulfonate ester | | |
| | | halogen | maleimido | | |
| | | halogen | haloacetyl | | |
| | | halogen | isocyanate | | |
| | | sulfonate ester | carboxyl | | |
| | | sulfonate ester | acyl chloride | | |
| | | sulfonate ester | anhydride | | |
| | | sulfonate ester | Ester | | |
| | | sulfonate ester | NHS | | |
| | | sulfonate ester | Halogen | | |
| | | sulfonate ester | sulfonate ester | | |
| | | sulfonate ester | maleimido | | |
| | | sulfonate ester | haloacetyl | | |
| | | sulfonate ester | isocyanate | | |
| | | maleimido | carboxyl | | |
| | | maleimido | acyl chloride | | |
| | | maleimido | anhydride | | |
| | | maleimido | Ester | | |
| | | maleimido | NHS | | |
| | | maleimido | Halogen | | |
| | | maleimido | sulfonate ester | | |
| | | maleimido | maleimido | | |
| | | maleimido | haloacetyl | | |
| | | maleimido | isocyanate | | |
| | | haloacetyl | carboxyl | | |
| | | haloacetyl | acyl chloride | | |
| | | haloacetyl | anhydride | | |
| | | haloacetyl | Ester | | |
| | | haloacetyl | NHS | | |
| | | haloacetyl | Halogen | | |
| | | haloacetyl | sulfonate ester | | |
| | | haloacetyl | maleimido | | |
| | | haloacetyl | haloacetyl | | |
| | | haloacetyl | isocyanate | | |
| | | isocyanate | carboxyl | | |
| | | isocyanate | acyl chloride | | |

| Both Nucleophilic | | Both Electrophilic | | Nucleophilic/Electrophilic | |
|---|---|---|---|---|---|
| A | B | A | B | A | B |
| | | isocyanate | anhydride | | |
| | | isocyanate | Ester | | |
| | | isocyanate | NHS | | |
| | | isocyanate | Halogen | | |
| | | isocyanate | sulfonate ester | | |
| | | isocyanate | maleimido | | |
| | | isocyanate | haloacetyl | | |
| | | isocyanate | isocyanate | | |

In some embodiments, A and B may include alkene and/or alkyne functional groups that are suitable for olefin metathesis reactions. In some embodiments, A and B include moieties that are suitable for click chemistry (e.g. alkene, alkynes, nitriles, azides). Other nonlimiting examples of reactive groups (A and B) include pyridyldithiol, aryl azide, diazirine, carbodiimide, and hydrazide.

In some embodiments, L is hydrophobic. Hydrophobic linkers are known in the art. See, e.g., *Bioconjugate Techniques*, G. T. Hermanson (Academic Press, San Diego, Calif., 1996), which is incorporated by reference in its entirety. Suitable hydrophobic linking groups known in the art include, for example, 8-hydroxyoctanoic acid and 8-mercaptooctanoic acid. Before conjugation to the peptides of the composition, the hydrophobic linking group comprises at least two reactive groups (A and B), as described herein and as shown below:

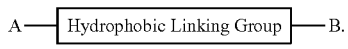

In some embodiments, the hydrophobic linking group comprises either a maleimido or an iodoacetyl group and either a carboxylic acid or an activated carboxylic acid (e.g. NHS ester) as the reactive groups. In these embodiments, the maleimido or iodoacetyl group can be coupled to a thiol moiety on Q or Y and the carboxylic acid or activated carboxylic acid can be coupled to an amine on Q or Y with or without the use of a coupling reagent. Any coupling agent known to one skilled in the art can be used to couple the carboxylic acid with the free amine such as, for example, DCC, DIC, HATU, HBTU, TBTU, and other activating agents described herein. In specific embodiments, the hydrophilic linking group comprises an aliphatic chain of 2 to 100 methylene groups wherein A and B are carboxyl groups or derivatives thereof (e.g. succinic acid). In other specific embodiments the L is iodoacetic acid.

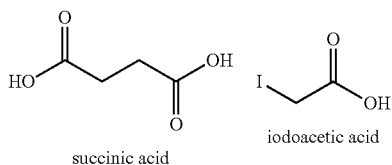

succinic acid    iodoacetic acid

In some embodiments, the linking group is hydrophilic such as, for example, polyalkylene glycol. Before conjugation to the peptides of the composition, the hydrophilic linking group comprises at least two reactive groups (A and B), as described herein and as shown below:

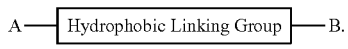

In specific embodiments, the linking group is polyethylene glycol (PEG). The PEG in certain embodiments has a molecular weight of about 100 Daltons to about 10,000 Daltons, e.g. about 500 Daltons to about 5000 Daltons. The PEG in some embodiments has a molecular weight of about 10,000 Daltons to about 40,000 Daltons.

In some embodiments, the hydrophilic linking group comprises either a maleimido or an iodoacetyl group and either a carboxylic acid or an activated carboxylic acid (e.g. NHS ester) as the reactive groups. In these embodiments, the maleimido or iodoacetyl group can be coupled to a thiol moiety on Q or Y and the carboxylic acid or activated carboxylic acid can be coupled to an amine on Q or Y with or without the use of a coupling reagent. Any appropriate coupling agent known to one skilled in the art can be used to couple the carboxylic acid with the amine such as, for example, DCC, DIC, HATU, HBTU, TBTU, and other activating agents described herein. In some embodiments, the linking group is maleimido-PEG (20 kDa)-COOH, iodoacetyl-PEG(20 kDa)-COOH, maleimido-PEG(20 kDa)-NHS, or iodoacetyl-PEG(20 kDa)-NHS.

In some embodiments, the linking group is comprised of an amino acid, a dipeptide, a tripeptide, or a polypeptide, wherein the amino acid, dipeptide, tripeptide, or polypeptide comprises at least two activating groups, as described herein. In some embodiments, the linking group (L) comprises a moiety selected from the group consisting of: amino, ether, thioether, maleimido, disulfide, amide, ester, thioester, alkene, cycloalkene, alkyne, trizoyl, carbamate, carbonate, cathepsin B-cleavable, and hydrazone.

In some embodiments, L comprises a chain of atoms from 1 to about 60, or 1 to 30 atoms or longer, 2 to 5 atoms, 2 to 10 atoms, 5 to 10 atoms, or 10 to 20 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, L provides a functional group that is subject to cleavage by an enzyme or other catalyst or hydrolytic conditions found in the target tissue or organ or cell. In some embodiments, the length of L is long enough to reduce the potential for steric hindrance.

Stability of L In Vivo

In some embodiments, L is stable in vivo. In some embodiments, L is stable in blood serum for at least 5 minutes, e.g. less than 25%, 20%, 15%, 10% or 5% of the conjugate is cleaved when incubated in serum for a period of 5 minutes. In other embodiments, L is stable in blood serum for at least 10, or 20, or 25, or 30, or 60, or 90, or 120 minutes, or 3, 4, 5, 6, 7, 8, 9, 10, 12, 15, 18 or 24 hours. In these embodiments, L does not comprise a functional group that is capable of undergoing hydrolysis in vivo. In some exemplary embodiments, L is stable in blood serum for at least about 72 hours.

In some embodiments, L is hydrolyzable in vivo. In these embodiments, L comprises a functional group that is capable of undergoing hydrolysis in vivo. Nonlimiting examples of functional groups that are capable of undergoing hydrolysis in vivo include esters, anhydrides, and thioesters. For example the following compound is capable of undergoing hydrolysis in vivo because it comprises an ester group:

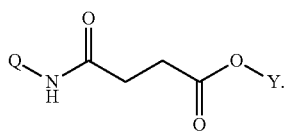

In some exemplary embodiments L is labile and undergoes substantial hydrolysis within 3 hours in blood plasma at 37° C., with complete hydrolysis within 6 hours. In some exemplary embodiments, L is not labile.

Nonlimiting examples of functional groups that are not capable of undergoing significant hydrolysis in vivo include amides, ethers, and thioethers. For example, the following compound is not capable of undergoing significant hydrolysis in vivo:

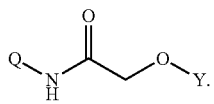

In some embodiments, L is metastable in vivo. In these embodiments, L comprises a functional group that is capable of being chemically or enzymatically cleaved in vivo (e.g., an acid-labile, reduction-labile, or enzyme-labile functional group), optionally over a period of time. In these embodiments, L can comprise, for example, a hydrazone moiety, a disulfide moiety, or a cathepsin-cleavable moiety. When L is metastable, and without intending to be bound by any particular theory, the Q-L-Y conjugate is stable in an extracellular environment, e.g., stable in blood serum for the time periods described above, but labile in the intracellular environment or conditions that mimic the intracellular environment, so that it cleaves upon entry into a cell. In some embodiments when L is metastable, L is stable in blood serum for at least about 24, 25, 26, 27, 28, 29, 30, 31, 32, 33, 34, 35, 36, 42, or 48 hours, for example, at least about 48, 54, 60, 66, or 72 hours, or about 24-48, 48-72, 24-60, 36-48, 36-72, or 48-72 hours.

Q-L-Y Conjugates
Conjugation of Q and Y

Conjugation of Q to Y through L can be carried out an any position within Q, including any of positions 1-29, a position within a C-terminal extension, or the C-terminal amino acid, provided that the activity of Q is retained, if not enhanced. Nonlimiting examples include positions 5, 7, 10, 11, 12, 13, 14, 15, 16, 17, 18, 19, 20, 21, 24, 27, 28, 29, 30, 37, 38, 39, 40, 41, 42, or 43 (according to the number of the amino acids of SEQ ID NO: 1601). In some embodiments, Y is conjugated to Q through L at one or more of positions 10, 20, 24, 30, 37, 38, 39, 40, 41, 32, or 43. In specific embodiments, Y is conjugated to Q through L at position 10 and/or 40 of Q.

Activity
Activity at the Glucagon Receptor and the GPCR

In some embodiments, Q-L-Y exhibits activity at both the glucagon receptor and a GPCR. In some embodiments, the activity (e.g., the $EC_{50}$ or the relative activity or potency) of Q at the glucagon receptor is within about 100-fold, about 75-fold, about 60-fold, about 50-fold, about 40-fold, about 30-fold, about 20-fold, about 10-fold, or about 5 fold different (higher or lower) from the activity (e.g., the $EC_{50}$ or the relative activity or potency) of Y at a GPCR. In some embodiments, the glucagon potency of Q is within about 25-, about 20-, about 15-, about 10-, or about 5-fold different (higher or lower) from the potency of Y.

In some embodiments, the ratio of the relative activity or the $EC_{50}$ or the potency of the Q at the glucagon receptor divided by the relative activity or the $EC_{50}$ or potency of Y at a GPCR is less than, or is about, X, wherein X is selected from 100, 75, 60, 50, 40, 30, 20, 15, 10, or 5. In some embodiments, the ratio of the $EC_{50}$ or potency or relative activity of Q at the glucagon receptor divided by the $EC_{50}$ or potency or relative activity of Y at a GPCR is about 1 less than 5 (e.g., about 4, about 3, about 2, about 1). In some embodiments, the ratio of the glucagon potency of Q compared to the GPCR activating potency of Y is less than, or is about, Z, wherein Z is selected from 100, 75, 60, 50, 40, 30, 20, 15, 10, and 5. In some embodiments, the ratio of the glucagon potency of Q compared to the GPCR activating potency of Y is less than 5 (e.g., about 4, about 3, about 2, about 1). In some embodiments, Q has an $EC_{50}$ at the glucagon receptor which is 2- to 10-fold (e.g., 2-fold, 3-fold, 4-fold, 5-fold, 6-fold, 7-fold, 8-fold, 9-fold, 10-fold) greater than the $EC_{50}$ of Y at a GPCR.

In some embodiments, the ratio of the relative activity or potency or the $EC_{50}$ of Y at a GPCR divided by the relative activity or potency or the $EC_{50}$ of Q at the glucagon receptor is less than, or is about, V, wherein V is selected from 100, 75, 60, 50, 40, 30, 20, 15, 10, or 5. In some embodiments, the ratio of the $EC_{50}$ or potency or relative activity of Y at a GPCR divided by the $EC_{50}$ or potency or relative activity of Q at the glucagon receptor is less than 5 (e.g., about 4, about 3, about 2, about 1). In some embodiments, the ratio of the GPCR activating potency of Y compared to the glucagon potency of Q is less than, or is about, W, wherein W is selected from 100, 75, 60, 50, 40, 30, 20, 15, 10, and 5. In some embodiments, the ratio of the GPCR activating potency of Y compared to the glucagon potency of Q is less than 5 (e.g., about 4, about 3, about 2, about 1). In some embodiments, Y has an $EC_{50}$ at a GPCR which is about 2- to about 10-fold (e.g., 2-fold, 3-fold, 4-fold, 5-fold, 6-fold, 7-fold, 8-fold, 9-fold, 10-fold) greater than the $EC_{50}$ of Q at the glucagon receptor.

In some embodiments, Y exhibits at least 0.1% (e.g., about 0.5% or more, about 1% or more, about 5% or more, about 10% or more, or more) of the activity of an endogenous ligand at a GPCR (GPCR activating potency) and Q exhibits at least 0.1% (e.g., about 0.5% or more, about 1% or more, about 5% or more, about 10% or more, or more) of the activity of native glucagon at the glucagon receptor (glucagon potency).

Activity at the GLP-1 Receptor and the GPCR

In some embodiments, Q-L-Y exhibits activity at both the GLP-1 receptor and a GPCR. In some embodiments, the activity (e.g., the $EC_{50}$ or the relative activity or potency) of Q at the GLP-1 receptor is within about 100-fold, about 75-fold, about 60-fold, about 50-fold, about 40-fold, about 30-fold, about 20-fold, about 10-fold, or about 5 fold different (higher or lower) from the activity (e.g., the $EC_{50}$ or the relative activity or potency) of Y at a GPCR. In some embodiments, the GLP-1 potency of Q is within about 25-, about 20-, about 15-, about 10-, or about 5-fold different (higher or lower) from the potency of Y.

In some embodiments, the ratio of the relative activity or the $EC_{50}$ or the potency of the Q at the GLP-1 receptor divided by the relative activity or the $EC_{50}$ or potency of Y at a GPCR is less than, or is about, X, wherein X is selected from 100, 75, 60, 50, 40, 30, 20, 15, 10, or 5. In some embodiments, the ratio of the $EC_{50}$ or potency or relative activity of Q at the GLP-1 receptor divided by the $EC_{50}$ or potency or relative activity of Y at a GPCR is about 1 less than 5 (e.g., about 4, about 3, about 2, about 1). In some embodiments, the ratio of the GLP-1 potency of Q compared to the GPCR activating potency of Y is less than, or is about, Z, wherein Z is selected from 100, 75, 60, 50, 40, 30, 20, 15, 10, and 5. In some embodiments, the ratio of the GLP-1 potency of Q compared to the GPCR activating potency of Y is less than 5 (e.g., about 4, about 3, about 2, about 1). In some embodiments, Q has an $EC_{50}$ at the GLP-1 receptor which is 2- to 10-fold (e.g., 2-fold, 3-fold, 4-fold, 5-fold, 6-fold, 7-fold, 8-fold, 9-fold, 10-fold) greater than the $EC_{50}$ of Y at a GPCR.

In some embodiments, the ratio of the relative activity or potency or the $EC_{50}$ of Y at a GPCR divided by the relative activity or potency or the $EC_{50}$ of Q at the GLP-1 receptor is less than, or is about, V, wherein V is selected from 100, 75, 60, 50, 40, 30, 20, 15, 10, or 5. In some embodiments, the ratio of the $EC_{50}$ or potency or relative activity of Y at a GPCR divided by the $EC_{50}$ or potency or relative activity of Q at the GLP-1 receptor is less than 5 (e.g., about 4, about 3, about 2, about 1). In some embodiments, the ratio of the GPCR activating potency of Y compared to the GLP-1 potency of Q is less than, or is about, W, wherein W is selected from 100, 75, 60, 50, 40, 30, 20, 15, 10, and 5. In some embodiments, the ratio of the GPCR activating potency of Y compared to the GLP-1 potency of Q is less than 5 (e.g., about 4, about 3, about 2, about 1). In some embodiments, Y has an $EC_{50}$ at a GPCR which is about 2- to about 10-fold (e.g., 2-fold, 3-fold, 4-fold, 5-fold, 6-fold, 7-fold, 8-fold, 9-fold, 10-fold) greater than the $EC_{50}$ of Q at the GLP-1 receptor.

In some embodiments, Y exhibits at least 0.1% (e.g., about 0.5% or more, about 1% or more, about 5% or more, about 10% or more, or more) of the activity of endogenous ligand at a GPCR (GPCR activating potency) and Q exhibits at least 0.1% (e.g., about 0.5% or more, about 1% or more, about 5% or more, about 10% or more, or more) of the activity of native GLP-1 at the GLP-1 receptor (GLP-1 potency).

Activity at the GIP Receptor and the GPCR

In some embodiments, Q-L-Y exhibits activity at both the GIP receptor and a GPCR. In some embodiments, the activity (e.g., the $EC_{50}$ or the relative activity or potency) of Q at the GIP receptor is within about 100-fold, about 75-fold, about 60-fold, about 50-fold, about 40-fold, about 30-fold, about 20-fold, about 10-fold, or about 5 fold different (higher or lower) from the activity (e.g., the $EC_{50}$ or the relative activity or potency) of Y at a GPCR. In some embodiments, the GIP potency of Q is within about 25-, about 20-, about 15-, about 10-, or about 5-fold different (higher or lower) from the potency of Y.

In some embodiments, the ratio of the relative activity or the $EC_{50}$ or the potency of the Q at the GIP receptor divided by the relative activity or the $EC_{50}$ or potency of Y at a GPCR is less than, or is about, X, wherein X is selected from 100, 75, 60, 50, 40, 30, 20, 15, 10, or 5. In some embodiments, the ratio of the $EC_{50}$ or potency or relative activity of Q at the GIP receptor divided by the $EC_{50}$ or potency or relative activity of Y at a GPCR is about 1 less than 5 (e.g., about 4, about 3, about 2, about 1). In some embodiments, the ratio of the GIP potency of Q compared to the GPCR activating potency of Y is less than, or is about, Z, wherein Z is selected from 100, 75, 60, 50, 40, 30, 20, 15, 10, and 5. In some embodiments, the ratio of the GIP potency of Q compared to the GPCR activating potency of Y is less than 5 (e.g., about 4, about 3, about 2, about 1). In some embodiments, Q has an $EC_{50}$ at the GIP receptor which is 2- to 10-fold (e.g., 2-fold, 3-fold, 4-fold, 5-fold, 6-fold, 7-fold, 8-fold, 9-fold, 10-fold) greater than the $EC_{50}$ of Y at a GPCR.

In some embodiments, the ratio of the relative activity or potency or the $EC_{50}$ of Y at a GPCR divided by the relative activity or potency or the $EC_{50}$ of Q at the GIP receptor is less than, or is about, V, wherein V is selected from 100, 75, 60, 50, 40, 30, 20, 15, 10, or 5. In some embodiments, the ratio of the $EC_{50}$ or potency or relative activity of Y at a GPCR divided by the $EC_{50}$ or potency or relative activity of Q at the GIP receptor is less than 5 (e.g., about 4, about 3, about 2, about 1). In some embodiments, the ratio of the GPCR activating potency of Y compared to the GIP potency of Q is less than, or is about, W, wherein W is selected from 100, 75, 60, 50, 40, 30, 20, 15, 10, and 5. In some embodiments, the ratio of the GPCR activating potency of Y compared to the GIP potency of Q is less than 5 (e.g., about 4, about 3, about 2, about 1). In some embodiments, Y has an $EC_{50}$ at a GPCR which is about 2- to about 10-fold (e.g., 2-fold, 3-fold, 4-fold, 5-fold, 6-fold, 7-fold, 8-fold, 9-fold, 10-fold) greater than the $EC_{50}$ of Q at the GIP receptor.

In some embodiments, Y exhibits at least 0.1% (e.g., about 0.5% or more, about 1% or more, about 5% or more, about 10% or more, or more) of the activity of endogenous ligand at a GPCR (GPCR activating potency) and Q exhibits at least 0.1% (e.g., about 0.5% or more, about 1% or more, about 5% or more, about 10% or more, or more) of the activity of native GIP at the GIP receptor (GIP potency).

Prodrugs of Q-L-Y

In some aspects of the invention, prodrugs of Q-L-Y are provided wherein the prodrug comprises a dipeptide prodrug element (A-B) covalently linked to an active site of Q via an amide linkage, as disclosed in International Patent Application No. PCT US09/68745 (filed on Dec. 18, 2009), which is incorporated herein by reference in its entirety. Subsequent removal of the dipeptide under physiological conditions and in the absence of enzymatic activity, restores full activity to the Q-L-Y conjugate.

In some embodiments a prodrug of Q-L-Y is provided having the general structure of A-B-Q-L-Y. In these embodiments A is an amino acid or a hydroxy acid and B is an N-alkylated amino acid linked to Q through formation of an amide bond between a carboxyl of B (in A-B) and an amine of Q. Furthermore, in some embodiments, A, B, or the amino acid of Q to which A-B is linked, is a non-coded amino acid, and chemical cleavage of A-B from Q is at least about 90% complete within about 1 to about 720 hours in PBS under physiological conditions. In another embodiment, chemical cleavage of A-B from Q is at least about 50% complete within about 1 hour or about 1 week in PBS under physiological conditions.

In some embodiment the dipeptide prodrug element (A-B) comprises a compound having the general structure below:

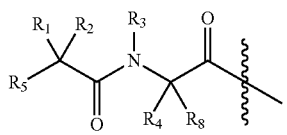

wherein $R_1$, $R_2$, $R_4$ and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)R$_7$, ($C_1$-$C_4$ alkyl)($C_3$-$C_9$ heteroaryl), and $C_1$-$C_{12}$ alkyl ($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl; or $R_4$ and $R_8$ together with the atoms to which they are attached form a $C_3$-$C_6$ cycloalkyl;

$R_3$ is selected from the group consisting of $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)R$_7$, and ($C_1$-$C_4$ alkyl)($C_3$-$C_9$ heteroaryl) or $R_4$ and $R_3$ together with the atoms to which they are attached form a 4, 5 or 6 member heterocyclic ring;

$R_5$ is NHR$_6$ or OH;

$R_6$ is H, $C_1$-$C_8$ alkyl or $R_6$ and $R_1$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo.

In some embodiments, the dipeptide prodrug element is linked to the amino terminus of Q. In other embodiments, the dipeptide prodrug is linked to an internal amino acid of Q, as described in International Patent Application No. PCT US09/68745.

The conjugates comprising the glucagon superfamily peptides of the invention (Q) and a GPCR ligand (Y) have synergistic pharmacology. The Q portion of these conjugates can act to direct the GPCR portion of the conjugate to targets of desired action to result in improved glycemic control (e.g. as measured by decreased glucose levels) and energy homeostasis (e.g. as measured by decreased body weight and/or fat mass), with an enhanced therapeutic index.

For example, in diet-induced obese mice, a fully active GLP-1 agonist with a stably-linked GPCR are more efficacious in reducing blood glucose and body weight than the comparative GLP-1 control, and the combined presence of GLP-1 and targeted GPCR can achieve superior reductions in glucose and body weight.

The "meta"-stable peptide-GPCR conjugates are stable in plasma but capable of releasing a GPCR ligand upon cellular internalization. These glucagon superfamily peptide/GPCR conjugates with metastable linkages are able to lower glucose levels and body weight to a greater extent than conjugates with labile linkages.

In exemplary embodiments, the conjugates are useful for treating any of the conditions described herein, including but not limited to a hyperglycemic medical condition, obesity, metabolic syndrome, and NAFLD.

Pharmaceutical Compositions

Salts

In some embodiments, the Q-L-Y conjugates described herein are in the form of a salt, e.g., a pharmaceutically acceptable salt. As used herein the term "pharmaceutically acceptable salt" refers to salts of compounds that retain the biological activity of the parent compound, and which are not biologically or otherwise undesirable. Such salts can be prepared in situ during the final isolation and purification of the conjugate, or separately prepared by reacting a free base function with a suitable acid. Many of the compounds disclosed herein are capable of forming acid and/or base salts by virtue of the presence of amino and/or carboxyl groups or groups similar thereto.

Pharmaceutically acceptable acid addition salts may be prepared from inorganic and organic acids. Representative acid addition salts include, but are not limited to acetate, adipate, alginate, citrate, aspartate, benzoate, benzenesulfonate, bisulfate, butyrate, camphorate, camphor sulfonate, digluconate, glycerophosphate, hemisulfate, heptanoate, hexanoate, fumarate, hydrochloride, hydrobromide, hydroiodide, 2-hydroxyethansulfonate (isothionate), lactate, maleate, methane sulfonate, nicotinate, 2-naphthalene sulfonate, oxalate, palmitoate, pectinate, persulfate, 3-phenylpropionate, picrate, pivalate, propionate, succinate, tartrate, thiocyanate, phosphate, glutamate, bicarbonate, p-toluenesulfonate, and undecanoate. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like. Examples of acids which can be employed to form pharmaceutically acceptable acid addition salts include, for example, an inorganic acid, e.g., hydrochloric acid, hydrobromic acid, sulphuric acid, and phosphoric acid, and an organic acid, e.g., oxalic acid, maleic acid, succinic acid, and citric acid.

Basic addition salts also can be prepared in situ during the final isolation and purification of the source of salicylic acid, or by reacting a carboxylic acid-containing moiety with a suitable base such as the hydroxide, carbonate, or bicarbonate of a pharmaceutically acceptable metal cation or with ammonia or an organic primary, secondary, or tertiary amine. Pharmaceutically acceptable salts include, but are not limited to, cations based on alkali metals or alkaline earth metals such as lithium, sodium, potassium, calcium, magnesium, and aluminum salts, and the like, and nontoxic quaternary ammonia and amine cations including ammonium, tetramethylammonium, tetraethylammonium, methylammonium, dimethylammonium, trimethylammonium, triethylammonium, diethylammonium, and ethylammonium, amongst others. Other representative organic amines useful for the formation of base addition salts include, for example, ethylenediamine, ethanolamine, diethanolamine, piperidine, piperazine, and the like. Salts derived from organic bases include, but are not limited to, salts of primary, secondary and tertiary amines.

Further, basic nitrogen-containing groups can be quaternized with the conjugate of the present disclosure as lower alkyl halides such as methyl, ethyl, propyl, and butyl chlorides, bromides, and iodides; long chain halides such as decyl, lauryl, myristyl, and stearyl chlorides, bromides, and iodides; arylalkyl halides like benzyl and phenethyl bromides and others. Water or oil-soluble or dispersible products are thereby obtained.

Formulations

In accordance with some embodiments, a pharmaceutical composition is provided wherein the composition comprises a Q-L-Y conjugate of the present disclosure, or pharmaceutically acceptable salt thereof, and a pharmaceutically acceptable carrier. The pharmaceutical composition can comprise any pharmaceutically acceptable ingredient, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface active agents, surfactants, suspending agents, sweetening agents, therapeutic agents, thickening agents, tonicity agents, toxicity agents, viscosity-increasing agents, water-absorbing agents, water-miscible cosolvents, water softeners, or wetting agents.

In some embodiments, the pharmaceutical composition comprises any one or a combination of the following components: acacia, acesulfame potassium, acetyltributyl citrate, acetyltriethyl citrate, agar, albumin, alcohol, dehydrated alcohol, denatured alcohol, dilute alcohol, aleuritic acid, alginic acid, aliphatic polyesters, alumina, aluminum hydroxide, aluminum stearate, amylopectin, α-amylose, ascorbic acid, ascorbyl palmitate, aspartame, bacteriostatic water for injection, bentonite, bentonite magma, benzalkonium chloride, benzethonium chloride, benzoic acid, benzyl alcohol, benzyl benzoate, bronopol, butylated hydroxyanisole, butylated hydroxytoluene, butylparaben, butylparaben sodium, calcium alginate, calcium ascorbate, calcium carbonate, calcium cyclamate, dibasic anhydrous calcium phosphate, dibasic dehydrate calcium phosphate, tribasic calcium phosphate, calcium propionate, calcium silicate, calcium sorbate, calcium stearate, calcium sulfate, calcium sulfate hemihydrate, canola oil, carbomer, carbon dioxide, carboxymethyl cellulose calcium, carboxymethyl cellulose sodium, β-carotene, carrageenan, castor oil, hydrogenated castor oil, cationic emulsifying wax, cellulose acetate, cellulose acetate phthalate, ethyl cellulose, microcrystalline cellulose, powdered cellulose, silicified microcrystalline cellulose, sodium carboxymethyl cellulose, cetostearyl alcohol, cetrimide, cetyl alcohol, chlorhexidine, chlorobutanol, chlorocresol, cholesterol, chlorhexidine acetate, chlorhexidine gluconate, chlorhexidine hydrochloride, chlorodifluoroethane (HCFC), chlorodifluoromethane, chlorofluorocarbons (CFC)chlorophenoxyethanol, chloroxylenol, corn syrup solids, anhydrous citric acid, citric acid monohydrate, cocoa butter, coloring agents, corn oil, cottonseed oil, cresol, m-cresol, o-cresol, p-cresol, croscarmellose sodium, crospovidone, cyclamic acid, cyclodextrins, dextrates, dextrin, dextrose, dextrose anhydrous, diazolidinyl urea, dibutyl phthalate, dibutyl sebacate, diethanolamine, diethyl phthalate, difluoroethane (HFC), dimethyl-β-cyclodextrin, cyclodextrin-type compounds such as Captisol®, dimethyl ether, dimethyl phthalate, dipotassium edentate, disodium edentate, disodium hydrogen phosphate, docusate calcium, docusate potassium, docusate sodium, dodecyl gallate, dodecyltrimethylammonium bromide, edentate calcium disodium, edtic acid, eglumine, ethyl alcohol, ethylcellulose, ethyl gallate, ethyl laurate, ethyl maltol, ethyl oleate, ethylparaben, ethylparaben potassium, ethylparaben sodium, ethyl vanillin, fructose, fructose liquid, fructose milled, fructose pyrogen-free, powdered fructose, fumaric acid, gelatin, glucose, liquid glucose, glyceride mixtures of saturated vegetable fatty acids, glycerin, glyceryl behenate, glyceryl monooleate, glyceryl monostearate, self-emulsifying glyceryl monostearate, glyceryl palmitostearate, glycine, glycols, glycofurol, guar gum, heptafluoropropane (HFC), hexadecyltrimethylammonium bromide, high fructose syrup, human serum albumin, hydrocarbons (HC), dilute hydrochloric acid, hydrogenated vegetable oil, type II, hydroxyethyl cellulose, 2-hydroxyethyl-β-cyclodextrin, hydroxypropyl cellulose, low-substituted hydroxypropyl cellulose, 2-hydroxypropyl-β-cyclodextrin, hydroxypropyl methylcellulose, hydroxypropyl methylcellulose phthalate, imidurea, indigo carmine, ion exchangers, iron oxides, isopropyl alcohol, isopropyl myristate, isopropyl palmitate, isotonic saline, kaolin, lactic acid, lactitol, lactose, lanolin, lanolin alcohols, anhydrous lanolin, lecithin, magnesium aluminum silicate, magnesium carbonate, normal magnesium carbonate, magnesium carbonate anhydrous, magnesium carbonate hydroxide, magnesium hydroxide, magnesium lauryl sulfate, magnesium oxide, magnesium silicate, magnesium stearate, magnesium trisilicate, magnesium trisilicate anhydrous, malic acid, malt, maltitol, maltitol solution, maltodextrin, maltol, maltose, mannitol, medium chain triglycerides, meglumine, menthol, methylcellulose, methyl methacrylate, methyl oleate, methylparaben, methylparaben potassium, methylparaben sodium, microcrystalline cellulose and carboxymethylcellulose sodium, mineral oil, light mineral oil, mineral oil and lanolin alcohols, oil, olive oil, monoethanolamine, montmorillonite, octyl gallate, oleic acid, palmitic acid, paraffin, peanut oil, petrolatum, petrolatum and lanolin alcohols, pharmaceutical glaze, phenol, liquified phenol, phenoxyethanol, phenoxypropanol, phenylethyl alcohol, phenylmercuric acetate, phenylmercuric borate, phenylmercuric nitrate, polacrilin, polacrilin potassium, poloxamer, polydextrose, polyethylene glycol, polyethylene oxide, polyacrylates, polyethylene-polyoxypropylene-block polymers, polymethacrylates, polyoxyethylene alkyl ethers, polyoxyethylene castor oil derivatives, polyoxyethylene sorbitol fatty acid esters, polyoxyethylene stearates, polyvinyl alcohol, polyvinyl pyrrolidone, potassium alginate, potassium benzoate, potassium bicarbonate, potassium bisulfite, potassium chloride, postassium citrate, potassium citrate anhydrous, potassium hydrogen phosphate, potassium metabisulfite, monobasic potassium phosphate, potassium propionate, potassium sorbate, povidone, propanol, propionic acid, propylene carbonate, propylene glycol, propylene glycol alginate, propyl gallate, propylparaben, propylparaben potassium, propylparaben sodium, protamine sulfate, rapeseed oil, Ringer's solution, saccharin, saccharin ammonium, saccharin calcium, saccharin sodium, safflower oil, saponite, serum proteins, sesame oil, colloidal silica, colloidal silicon dioxide, sodium alginate, sodium ascorbate, sodium benzoate, sodium bicarbonate, sodium bisulfite, sodium chloride, anhydrous sodium citrate, sodium citrate dehydrate, sodium chloride, sodium cyclamate, sodium edentate, sodium dodecyl sulfate, sodium lauryl sulfate, sodium metabisulfite, sodium phosphate, dibasic, sodium phosphate, monobasic, sodium phosphate, tribasic, anhydrous sodium propionate, sodium propionate, sodium sorbate, sodium starch glycolate, sodium stearyl fumarate, sodium sulfite, sorbic acid, sorbitan esters (sorbitan fatty esters), sorbitol, sorbitol solution 70%, soybean oil, spermaceti wax, starch, corn starch, potato starch, pregelatinized starch, sterilizable maize starch, stearic acid, purified stearic acid, stearyl alcohol, sucrose, sugars, compressible sugar, confectioner's sugar, sugar spheres, invert sugar, Sugartab, Sunset Yellow FCF, synthetic paraffin, talc, tartaric acid, tartrazine, tetrafluoroethane (HFC), theobroma oil, thimerosal, titanium dioxide, alpha tocopherol, tocopheryl acetate, alpha tocopheryl acid succinate, beta-tocopherol, delta-tocopherol, gamma-tocopherol, tragacanth, triacetin, tributyl citrate, triethanolamine, triethyl citrate, trimethyl-β-cyclodextrin, trimethyltetradecylammonium bromide, tris buffer, trisodium edentate, vanillin, type I hydrogenated vegetable oil, water, soft water, hard water, carbon dioxide-free water, pyrogen-free water, water for injection, sterile water for inhalation, sterile water for injection, sterile water for irrigation, waxes, anionic emulsifying wax, carnauba wax, cationic emulsifying wax, cetyl ester wax, microcrystalline wax, nonionic emulsifying wax, suppository wax, white wax, yellow wax, white petrolatum, wool fat, xanthan gum, xylitol, zein, zinc propionate, zinc salts, zinc stearate, or any excipient in the *Handbook of Pharmaceutical Excipients*, Third Edition, A. H. Kibbe (Pharmaceutical Press, London, UK, 2000), which is incorporated by reference in its entirety. *Remington's Pharmaceutical Sciences*, Sixteenth Edition, E. W. Martin (Mack Publishing Co., Easton, Pa., 1980), which is incorporated by reference in its entirety, discloses various components used in formulating pharmaceutically acceptable compositions and known techniques for the preparation thereof. Except insofar as any conventional agent is incompatible with the pharmaceutical compositions, its use in pharmaceutical compositions is contemplated. Supplementary active ingredients also can be incorporated into the compositions.

In some embodiments, the foregoing component(s) may be present in the pharmaceutical composition at any concentration, such as, for example, at least A, wherein A is 0.0001% w/v, 0.001% w/v, 0.01% w/v, 0.1% w/v, 1% w/v, 2% w/v, 5% w/v, 10% w/v, 20% w/v, 30% w/v, 40% w/v, 50% w/v, 60% w/v, 70% w/v, 80% w/v, or 90% w/v. In some embodiments, the foregoing component(s) may be present in the pharmaceutical composition at any concentration, such as, for example, at most B, wherein B is 90% w/v, 80% w/v, 70% w/v, 60% w/v, 50% w/v, 40% w/v, 30% w/v, 20% w/v, 10% w/v, 5% w/v, 2% w/v, 1% w/v, 0.1% w/v, 0.001% w/v, or 0.0001%. In other embodiments, the foregoing component(s) may be present in the pharmaceutical composition at any concentration range, such as, for example from about A to about B. In some embodiments, A is 0.0001% and B is 90%.

The pharmaceutical compositions may be formulated to achieve a physiologically compatible pH. In some embodiments, the pH of the pharmaceutical composition may be at least 5, at least 5.5, at least 6, at least 6.5, at least 7, at least 7.5, at least 8, at least 8.5, at least 9, at least 9.5, at least 10, or at least 10.5 up to and including pH 11, depending on the formulation and route of administration. In certain embodiments, the pharmaceutical compositions may comprise buffering agents to achieve a physiological compatible pH. The buffering agents may include any compounds capable of buffering at the desired pH such as, for example, phosphate buffers (e.g., PBS), triethanolamine, Tris, bicine, TAPS, tricine, HEPES, TES, MOPS, PIPES, cacodylate, MES, and others. In certain embodiments, the strength of the buffer is at least 0.5 mM, at least 1 mM, at least 5 mM, at least 10 mM, at least 20 mM, at least 30 mM, at least 40 mM, at least 50 mM, at least 60 mM, at least 70 mM, at least 80 mM, at least 90 mM, at least 100 mM, at least 120 mM, at least 150 mM, or at least 200 mM. In some embodiments, the strength of the buffer is no more than 300 mM (e.g., at most 200 mM, at most 100 mM, at most 90 mM, at most 80 mM, at most 70 mM, at most 60 mM, at most 50 mM, at most 40 mM, at most 30 mM, at most 20 mM, at most 10 mM, at most 5 mM, at most 1 mM).

Routes of Administration

The following discussion on routes of administration is merely provided to illustrate exemplary embodiments and should not be construed as limiting the scope in any way.

Formulations suitable for oral administration can consist of (a) liquid solutions, such as an effective amount of the conjugate of the present disclosure dissolved in diluents, such as water, saline, or orange juice; (b) capsules, sachets, tablets, lozenges, and troches, each containing a predetermined amount of the active ingredient, as solids or granules; (c) powders; (d) suspensions in an appropriate liquid; and (e) suitable emulsions. Liquid formulations may include diluents, such as water and alcohols, for example, ethanol, benzyl alcohol, and the polyethylene alcohols, either with or without the addition of a pharmaceutically acceptable surfactant. Capsule forms can be of the ordinary hard- or soft-shelled gelatin type containing, for example, surfactants, lubricants, and inert fillers, such as lactose, sucrose, calcium phosphate, and corn starch. Tablet forms can include one or more of lactose, sucrose, mannitol, corn starch, potato starch, alginic acid, microcrystalline cellulose, acacia, gelatin, guar gum, colloidal silicon dioxide, croscarmellose sodium, talc, magnesium stearate, calcium stearate, zinc stearate, stearic acid, and other excipients, colorants, diluents, buffering agents, disintegrating agents, moistening agents, preservatives, flavoring agents, and other pharmacologically compatible excipients. Lozenge forms can comprise the conjugate of the present disclosure in a flavor, usually sucrose and acacia or tragacanth, as well as pastilles comprising the conjugate of the present disclosure in an inert base, such as gelatin and glycerin, or sucrose and acacia, emulsions, gels, and the like containing, in addition to, such excipients as are known in the art.

The conjugates of the disclosure, alone or in combination with other suitable components, can be delivered via pulmonary administration and can be made into aerosol formulations to be administered via inhalation. These aerosol formulations can be placed into pressurized acceptable propellants, such as dichlorodifluoromethane, propane, nitrogen, and the like. They also may be formulated as pharmaceuticals for non-pressured preparations, such as in a nebulizer or an atomizer. Such spray formulations also may be used to spray mucosa. In some embodiments, the conjugate is formulated into a powder blend or into microparticles or nanoparticles. Suitable pulmonary formulations are known in the art. See, e.g., Qian et al., Int J Pharm 366: 218-220 (2009); Adjei and Garren, Pharmaceutical Research, 7(6): 565-569 (1990); Kawashima et al., J Controlled Release 62(1-2): 279-287 (1999); Liu et al., Pharm Res 10(2): 228-232 (1993); International Patent Application Publication Nos. WO 2007/133747 and WO 2007/141411.

Formulations suitable for parenteral administration include aqueous and non-aqueous, isotonic sterile injection solutions, which can contain anti-oxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The term, "parenteral" means not through the alimentary canal but by some other route such as subcutaneous, intramuscular, intraspinal, or intravenous. The conjugate of the present disclosure can be administered with a physiologically acceptable diluent in a pharmaceutical carrier, such as a sterile liquid or mixture of liquids, including water, saline, aqueous dextrose and related sugar solutions, an alcohol, such as ethanol or hexadecyl alcohol, a glycol, such as propylene glycol or polyethylene glycol, dimethylsulfoxide, glycerol, ketals such as 2,2-dimethyl-153-dioxolane-4-methanol, ethers, poly(ethyleneglycol) 400, oils, fatty acids, fatty acid esters or glycerides, or acetylated fatty acid glycerides with or without the addition of a pharmaceutically acceptable surfactant, such as a soap or a detergent, suspending agent, such as pectin, carbomers, methylcellulose, hydroxypropylmethylcellulose, or carboxymethylcellulose, or emulsifying agents and other pharmaceutical adjuvants.

Oils, which can be used in parenteral formulations include petroleum, animal, vegetable, or synthetic oils. Specific examples of oils include peanut, soybean, sesame, cottonseed, corn, olive, petrolatum, and mineral. Suitable fatty acids for use in parenteral formulations include oleic acid, stearic acid, and isostearic acid. Ethyl oleate and isopropyl myristate are examples of suitable fatty acid esters.

Suitable soaps for use in parenteral formulations include fatty alkali metal, ammonium, and triethanolamine salts, and suitable detergents include (a) cationic detergents such as, for example, dimethyl dialkyl ammonium halides, and alkyl pyridinium halides, (b) anionic detergents such as, for example, alkyl, aryl, and olefin sulfonates, alkyl, olefin, ether, and monoglyceride sulfates, and sulfosuccinates, (c) nonionic detergents such as, for example, fatty amine oxides, fatty acid alkanolamides, and polyoxyethylenepolypropylene copolymers, (d) amphoteric detergents such as, for example, alkyl-β-aminopropionates, and 2-alkyl-imidazoline quaternary ammonium salts, and (e) mixtures thereof.

The parenteral formulations will typically contain from about 0.5% to about 25% by weight of Q-L-Y conjugate of the present disclosure in solution. Preservatives and buffers may be used. In order to minimize or eliminate irritation at the site of injection, such compositions may contain one or more nonionic surfactants having a hydrophile-lipophile balance (HLB) of from about 12 to about 17. The quantity of surfactant in such formulations will typically range from about 5% to about 15% by weight. Suitable surfactants include polyethylene glycol sorbitan fatty acid esters, such as sorbitan monooleate and the high molecular weight adducts of ethylene oxide with a hydrophobic base, formed by the condensation of propylene oxide with propylene glycol. The parenteral formulations can be presented in unit-dose or multi-dose sealed containers, such as ampoules and vials, and can be stored in a freeze-dried (lyophilized) condition requiring only the addition of the sterile liquid excipient, for example, water, for injections, immediately prior to use. Extemporaneous injection solutions and suspensions can be prepared from sterile powders, granules, and tablets of the kind previously described.

Injectable formulations are in accordance with the invention. The requirements for effective pharmaceutical carriers for injectable compositions are well-known to those of ordinary skill in the art (see, e.g., *Pharmaceutics and Pharmacy Practice*, J. B. Lippincott Company, Philadelphia, Pa., Banker and Chalmers, eds., pages 238-250 (1982), and *ASHP Handbook on Injectable Drugs*, Toissel, 4th ed., pages 622-630 (1986)).

Additionally, the conjugate of the present disclosures can be made into suppositories for rectal administration by mixing with a variety of bases, such as emulsifying bases or water-soluble bases. Formulations suitable for vaginal administration can be presented as pessaries, tampons, creams, gels, pastes, foams, or spray formulas containing, in addition to the active ingredient, such carriers as are known in the art to be appropriate.

It will be appreciated by one of skill in the art that, in addition to the above-described pharmaceutical compositions, the conjugate of the disclosure can be formulated as inclusion complexes, such as cyclodextrin inclusion complexes, or liposomes.

Dose

The Q-L-Y conjugates of the disclosure are believed to be useful in methods of treating a disease or medical condition in which glucagon receptor agonism, GLP-1 receptor agonism, GIP receptor agonism, glucagon receptor/GLP-1 receptor co-agonism, glucagon receptor/GIP receptor co-agonism, GLP-1 receptor/GIP receptor co-agonism or glucagon receptor/GLP-1 receptor/GIP receptor tri-agonism plays a role. For purposes of the disclosure, the amount or dose of the conjugate of the present disclosure administered should be sufficient to effect, e.g., a therapeutic or prophylactic response, in the subject or animal over a reasonable time frame. For example, the dose of the conjugate of the present disclosure should be sufficient to stimulate cAMP secretion from cells as described herein or sufficient to decrease blood glucose levels, fat levels, food intake levels, or body weight of a mammal, in a period of from about 1 to 4 minutes, 1 to 4 hours or 1 to 4 weeks or longer, e.g., 5 to 20 or more weeks, from the time of administration. In certain embodiments, the time period could be even longer. The dose will be determined by the efficacy of the particular conjugate of the present disclosure and the condition of the animal (e.g., human), as well as the body weight of the animal (e.g., human) to be treated.

Many assays for determining an administered dose are known in the art. For purposes herein, an assay, which comprises comparing the extent to which blood glucose levels are lowered upon administration of a given dose of the conjugate of the present disclosure to a mammal among a set of mammals of which is each given a different dose of the conjugate, could be used to determine a starting dose to be administered to a mammal. The extent to which blood glucose levels are lowered upon administration of a certain dose can be assayed by methods known in the art.

The dose of the conjugate of the present disclosure also will be determined by the existence, nature and extent of any adverse side effects that might accompany the administration of a particular conjugate of the present disclosure. Typically, the attending physician will decide the dosage of the conjugate of the present disclosure with which to treat each individual patient, taking into consideration a variety of factors, such as age, body weight, general health, diet, sex, conjugate of the present disclosure to be administered, route of administration, and the severity of the condition being treated. By way of example and not intending to limit the invention, the dose of the conjugate of the present disclosure can be about 0.0001 to about 1 g/kg body weight of the subject being treated/day, from about 0.0001 to about 0.001 g/kg body weight/day, or about 0.01 mg to about 1 g/kg body weight/day.

In some embodiments, the pharmaceutical composition comprises any of the conjugates disclosed herein at a purity level suitable for administration to a patient. In some embodiments, the conjugate has a purity level of at least about 90%, about 91%, about 92%, about 93%, about 94%, about 95%, about 96%, about 97%, about 98% or about 99%, and a pharmaceutically acceptable diluent, carrier or excipient. The pharmaceutical composition in some aspects comprise the conjugate of the present disclosure at a concentration of at least A, wherein A is about 0.001 mg/ml, about 0.01 mg/ml, 0 about 1 mg/ml, about 0.5 mg/ml, about 1 mg/ml, about 2 mg/ml, about 3 mg/ml, about 4 mg/ml, about 5 mg/ml, about 6 mg/ml, about 7 mg/ml, about 8 mg/ml, about 9 mg/ml, about 10 mg/ml, about 11 mg/ml, about 12 mg/ml, about 13 mg/ml, about 14 mg/ml, about 15 mg/ml, about 16 mg/ml, about 17 mg/ml, about 18 mg/ml, about 19 mg/ml, about 20 mg/ml, about 21 mg/ml, about 22 mg/ml, about 23 mg/ml, about 24 mg/ml, about 25 mg/ml or higher. In some embodiments, the pharmaceutical composition comprises the conjugate at a concentration of at most B, wherein B is about 30 mg/ml, about 25 mg/ml, about 24 mg/ml, about 23, mg/ml, about 22 mg/ml, about 21 mg/ml, about 20 mg/ml, about 19 mg/ml, about 18 mg/ml, about 17 mg/ml, about 16 mg/ml, about 15 mg/ml, about 14 mg/ml, about 13 mg/ml, about 12 mg/ml, about 11 mg/ml, about 10 mg/ml, about 9 mg/ml, about 8 mg/ml, about 7 mg/ml, about 6 mg/ml, about 5 mg/ml, about 4 mg/ml, about 3 mg/ml, about 2 mg/ml, about 1 mg/ml, or about 0.1 mg/ml. In some embodiments, the compositions may contain an conjugate at a concentration range of A to B mg/ml, for example, about 0.001 to about 30.0 mg/ml.

Targeted Forms

One of ordinary skill in the art will readily appreciate that the Q-L-Y conjugates of the disclosure can be modified in any number of ways, such that the therapeutic or prophylactic efficacy of the conjugate of the present disclosures is increased through the modification. For instance, the conjugate of the present disclosure can be further conjugated either directly or indirectly through a linker to a targeting moiety. The practice of conjugating compounds, e.g., glucagon conjugates described herein, to targeting moieties is known in the art. See, for instance, Wadhwa et al., J Drug Targeting, 3, 111-127 (1995) and U.S. Pat. No. 5,087,616. The term "targeting moiety" as used herein, refers to any molecule or agent that specifically recognizes and binds to a cell-surface receptor, such that the targeting moiety directs the delivery of the conjugate of the present disclosures to a population of cells on which surface the receptor (the glucagon receptor, the GLP-1 receptor) is expressed. Targeting moieties include, but are not limited to, antibodies, or fragments thereof, peptides, hormones, growth factors, cytokines, and any other natural or non-natural ligands, which bind to cell surface receptors (e.g., Epithelial Growth Factor Receptor (EGFR), T-cell receptor (TCR), B-cell receptor (BCR), CD28, Platelet-derived Growth Factor Receptor (PDGF), nicotinic acetylcholine receptor (nAChR), etc.). As used herein a "linker" is a bond, molecule or group of molecules that binds two separate entities to one another. Linkers may provide for optimal spacing of the two entities or may further supply a labile linkage that allows the two entities to be separated from each other. Labile linkages include photocleavable groups, acid-labile moieties, base-labile moieties, hydrolyzable groups, and enzyme-cleavable groups. The term "linker" in some embodiments refers to any agent or molecule that bridges the conjugate of the present disclosures to the targeting moiety. One of ordinary skill in the art recognizes that sites on the conjugate of the present disclosures, which are not necessary for the function of the conjugate of the present disclosures, are ideal sites for attaching a linker and/or a targeting moiety, provided that the linker and/or targeting moiety, once attached to the conjugate of the present disclosures, do(es) not interfere with the function of the conjugate of the present disclosures, i.e., the ability to stimulate cAMP secretion from cells, to treat diabetes or obesity. One of ordinary skill in the art recognizes that sites on the peptide of the present disclosures (Q), which are not necessary for the function of the peptide of the present disclosures (e.g., glucagon agonist peptide, glucagon antagonist peptide, GLP-1 agonist peptide, GIP agonist peptide, or a combination of any of the foregoing), are ideal sites for attaching a linker and/or a targeting moiety, provided that the linker and/or targeting moiety, once attached to the peptide of the present disclosures (Q), does not interfere with the function of the peptide of the present disclosures.

Controlled Release Formulations

Alternatively, the glucagon conjugates described herein can be modified into a depot form, such that the manner in which the conjugate of the present disclosures is released into the body to which it is administered is controlled with respect to time and location within the body (see, for example, U.S. Pat. No. 4,450,150). Depot forms of conjugate of the present disclosures can be, for example, an implantable composition comprising the conjugate of the present disclosures and a porous or non-porous material, such as a polymer, wherein the conjugate of the present disclosures is encapsulated by or diffused throughout the material and/or degradation of the non-porous material. The depot is then implanted into the desired location within the body and the conjugate of the present disclosures are released from the implant at a predetermined rate.

The pharmaceutical composition in certain aspects is modified to have any type of in vivo release profile. In some aspects, the pharmaceutical composition is an immediate release, controlled release, sustained release, extended release, delayed release, or bi-phasic release formulation. Methods of formulating peptides or conjugates for controlled release are known in the art. See, for example, Qian et al., J Pharm 374: 46-52 (2009) and International Patent Application Publication Nos. WO 2008/130158, WO2004/033036; WO2000/032218; and WO 1999/040942.

The instant compositions may further comprise, for example, micelles or liposomes, or some other encapsulated form, or may be administered in an extended release form to provide a prolonged storage and/or delivery effect. The disclosed pharmaceutical formulations may be administered according to any regime including, for example, daily (1 time per day, 2 times per day, 3 times per day, 4 times per day, 5 times per day, 6 times per day), every two days, every three days, every four days, every five days, every six days, weekly, bi-weekly, every three weeks, monthly, or bi-monthly.

Uses

Based on the information provided for the first time herein, it is contemplated that the Q-L-Y conjugates described herein and related pharmaceutical compositions are useful for treatment of a disease or medical condition, in which e.g., the lack of activity at the glucagon receptor, the GLP-1 receptor, the GIP receptor or a combination of any of the foregoing, is a factor in the onset and/or progression of the disease or medical condition. Accordingly, the invention provides a method of treating or preventing a disease or medical condition in a patient, wherein the disease or medical condition is a disease of medical condition in which a lack of GLP-1 receptor activation and/or glucagon receptor activation and/or GIP activation is associated with the onset and/or progression of the disease of medical condition. The method comprises providing to the patient an conjugate in accordance with any of those described herein in an amount effective to treat or prevent the disease or medical condition.

In some embodiments, the disease or medical condition is metabolic syndrome. Metabolic Syndrome, also known as metabolic syndrome X, insulin resistance syndrome or Reaven's syndrome, is a disorder that affects over 50 million Americans. Metabolic Syndrome is typically characterized by a clustering of at least three or more of the following risk factors: (1) abdominal obesity (excessive fat tissue in and around the abdomen), (2) atherogenic dyslipidemia (blood fat disorders including high triglycerides, low HDL cholesterol and high LDL cholesterol that enhance the accumulation of plaque in the artery walls), (3) elevated blood pressure, (4)

insulin resistance or glucose intolerance, (5) prothrombotic state (e.g., high fibrinogen or plasminogen activator inhibitor-1 in blood), and (6) pro-inflammatory state (e.g., elevated C-reactive protein in blood). Other risk factors may include aging, hormonal imbalance and genetic predisposition.

Metabolic Syndrome is associated with an increased risk of coronary heart disease and other disorders related to the accumulation of vascular plaque, such as stroke and peripheral vascular disease, referred to as atherosclerotic cardiovascular disease (ASCVD). Patients with Metabolic Syndrome may progress from an insulin resistant state in its early stages to full blown type II diabetes with further increasing risk of ASCVD. Without intending to be bound by any particular theory, the relationship between insulin resistance, Metabolic Syndrome and vascular disease may involve one or more concurrent pathogenic mechanisms including impaired insulin-stimulated vasodilation, insulin resistance-associated reduction in NO availability due to enhanced oxidative stress, and abnormalities in adipocyte-derived hormones such as adiponectin (Lteif and Mather, Can. J. Cardiol. 20 (suppl. B):66B-76B (2004)).

According to the 2001 National Cholesterol Education Program Adult Treatment Panel (ATP III), any three of the following traits in the same individual meet the criteria for Metabolic Syndrome: (a) abdominal obesity (a waist circumference over 102 cm in men and over 88 cm in women); (b) serum triglycerides (150 mg/dl or above); (c) HDL cholesterol (40 mg/dl or lower in men and 50 mg/dl or lower in women); (d) blood pressure (130/85 or more); and (e) fasting blood glucose (110 mg/dl or above). According to the World Health Organization (WHO), an individual having high insulin levels (an elevated fasting blood glucose or an elevated post meal glucose alone) with at least two of the following criteria meets the criteria for Metabolic Syndrome: (a) abdominal obesity (waist to hip ratio of greater than 0.9, a body mass index of at least 30 kg/m2, or a waist measurement over 37 inches); (b) cholesterol panel showing a triglyceride level of at least 150 mg/dl or an HDL cholesterol lower than 35 mg/dl; (c) blood pressure of 140/90 or more, or on treatment for high blood pressure). (Mathur, Ruchi, "Metabolic Syndrome," ed. Shiel, Jr., William C., MedicineNet.com, May 11, 2009).

For purposes herein, if an individual meets the criteria of either or both of the criteria set forth by the 2001 National Cholesterol Education Program Adult Treatment Panel or the WHO, that individual is considered as afflicted with Metabolic Syndrome.

Without being bound to any particular theory, Q-L-Y conjugates described herein are useful for treating Metabolic Syndrome. Accordingly, the invention provides a method of preventing or treating Metabolic Syndrome, or reducing one, two, three or more risk factors thereof, in a subject, comprising providing to the subject a conjugate described herein in an amount effective to prevent or treat Metabolic Syndrome, or the risk factor thereof.

In some embodiments, the method treats a hyperglycemic medical condition. In certain aspects, the hyperglycemic medical condition is diabetes, diabetes mellitus type I, diabetes mellitus type II, or gestational diabetes, either insulin-dependent or non-insulin-dependent. In some aspects, the method treats the hyperglycemic medical condition by reducing one or more complications of diabetes including nephropathy, retinopathy and vascular disease.

In some aspects, the disease or medical condition is obesity. In some aspects, the obesity is drug-induced obesity. In some aspects, the method treats obesity by preventing or reducing weight gain or increasing weight loss in the patient. In some aspects, the method treats obesity by reducing appetite, decreasing food intake, lowering the levels of fat in the patient, or decreasing the rate of movement of food through the gastrointestinal system.

Because obesity is associated with the onset or progression of other diseases, the methods of treating obesity are further useful in methods of reducing complications associated with obesity including vascular disease (coronary artery disease, stroke, peripheral vascular disease, ischemia reperfusion, etc.), hypertension, onset of diabetes type II, hyperlipidemia and musculoskeletal diseases. The invention accordingly provides methods of treating or preventing these obesity-associated complications.

In some embodiments, the disease or medical condition is Nonalcoholic fatty liver disease (NAFLD). NAFLD refers to a wide spectrum of liver disease ranging from simple fatty liver (steatosis), to nonalcoholic steatohepatitis (NASH), to cirrhosis (irreversible, advanced scarring of the liver). All of the stages of NAFLD have in common the accumulation of fat (fatty infiltration) in the liver cells (hepatocytes). Simple fatty liver is the abnormal accumulation of a certain type of fat, triglyceride, in the liver cells with no inflammation or scarring. In NASH, the fat accumulation is associated with varying degrees of inflammation (hepatitis) and scarring (fibrosis) of the liver. The inflammatory cells can destroy the liver cells (hepatocellular necrosis). In the terms "steatohepatitis" and "steatonecrosis", steato refers to fatty infiltration, hepatitis refers to inflammation in the liver, and necrosis refers to destroyed liver cells. NASH can ultimately lead to scarring of the liver (fibrosis) and then irreversible, advanced scarring (cirrhosis). Cirrhosis that is caused by NASH is the last and most severe stage in the NAFLD spectrum. (Mendler, Michel, "Fatty Liver: Nonalcoholic Fatty Liver Disease (NAFLD) and Nonalcoholic Steatohepatitis (NASH)," ed. Schoenfield, Leslie J., MedicineNet.com, Aug. 29, 2005).

Alcoholic Liver Disease, or Alcohol-Induced Liver Disease, encompasses three pathologically distinct liver diseases related to or caused by the excessive consumption of alcohol: fatty liver (steatosis), chronic or acute hepatitis, and cirrhosis. Alcoholic hepatitis can range from a mild hepatitis, with abnormal laboratory tests being the only indication of disease, to severe liver dysfunction with complications such as jaundice (yellow skin caused by bilirubin retention), hepatic encephalopathy (neurological dysfunction caused by liver failure), ascites (fluid accumulation in the abdomen), bleeding esophageal varices (varicose veins in the esophagus), abnormal blood clotting and coma. Histologically, alcoholic hepatitis has a characteristic appearance with ballooning degeneration of hepatocytes, inflammation with neutrophils and sometimes Mallory bodies (abnormal aggregations of cellular intermediate filament proteins). Cirrhosis is characterized anatomically by widespread nodules in the liver combined with fibrosis. (Worman, Howard J., "Alcoholic Liver Disease", Columbia University Medical Center website).

Without being bound to any particular theory, the Q-L-Y conjugates described herein are useful for the treatment of Alcoholic Liver Disease, NAFLD, or any stage thereof, including, for example, steatosis, steatohepatitis, hepatitis, hepatic inflammation, NASH, cirrhosis, or complications thereof. Accordingly, the invention provides a method of preventing or treating Alcoholic Liver Disease, NAFLD, or any stage thereof, in a subject comprising providing to a subject a conjugate described herein in an amount effective to prevent or treat Alcoholic Liver Disease, NAFLD, or the stage thereof. Such treatment methods include reduction in one, two, three or more of the following: liver fat content, incidence or progression of cirrhosis, incidence of hepatocellular carcinoma, signs of inflammation, e.g., abnormal hepatic enzyme levels (e.g., aspartate aminotransferase AST and/or alanine aminotransferase ALT, or LDH), elevated serum ferritin, elevated serum bilirubin, and/or signs of fibrosis, e.g., elevated TGF-beta levels. In preferred embodiments, the Q-L-Y conjugates described herein are used treat patients who have progressed beyond simple fatty liver (steatosis) and exhibit signs of inflammation or hepatitis. Such methods may result, for example, in reduction of AST and/or ALT levels.

GLP-1 and exendin-4 have been shown to have some neuroprotective effect. The invention also provides uses of the Q-L-Y conjugates described herein in treating neurodegenerative diseases, including but not limited to Alzheimer's disease, Parkinson's disease, Multiple Sclerosis, Amylotrophic Lateral Sclerosis, other demyelination related disorders, senile dementia, subcortical dementia, arteriosclerotic dementia, AIDS-associated dementia, or other dementias, a central nervous system cancer, traumatic brain injury, spinal cord injury, stroke or cerebral ischemia, cerebral vasculitis, epilepsy, Huntington's disease, Tourette's syndrome, Guillain Barre syndrome, Wilson disease, Pick's disease, neuroinflammatory disorders, encephalitis, encephalomyelitis or meningitis of viral, fungal or bacterial origin, or other central nervous system infections, prion diseases, cerebellar ataxias, cerebellar degeneration, spinocerebellar degeneration syndromes, Friedreichs ataxia, ataxia telangiectasia, spinal dysmyotrophy, progressive supranuclear palsy, dystonia, muscle spasticity, tremor, retinitis pigmentosa, striatonigral degeneration, mitochondrial encephalomyopathies, neuronal ceroid lipofuscinosis, hepatic encephalopathies, renal encephalopathies, metabolic encephalopathies, toxin-induced encephalopathies, and radiation-induced brain damage.

In some embodiments, the disease or medical condition is hypoglycemia. In some embodiments, the patient is a diabetic patient and the hypoglycemia is induced by the administration of insulin. In specific aspects, the method comprises providing the conjugate of the present disclosure in combination with insulin so that the conjugate buffers the hypoglycemic effects of the bolus administration of insulin.

In some embodiments, the Q-L-Y conjugates are used in conjunction with parenteral administration of nutrients to non-diabetic patients in a hospital setting, e.g., to patients receiving parenteral nutrition or total parenteral nutrition. Nonlimiting examples include surgery patients, patients in comas, patients with digestive tract illness, or a nonfunctional gastrointestinal tract (e.g. due to surgical removal, blockage or impaired absorptive capacity, Crohn's disease, ulcerative colitis, gastrointestinal tract obstruction, gastrointestinal tract fistula, acute pancreatitis, ischemic bowel, major gastrointestinal surgery, certain congenital gastrointestinal tract anomalies, prolonged diarrhea, or short bowel syndrome due to surgery, patients in shock, and patients undergoing healing processes often receive parenteral administration of carbohydrates along with various combinations of lipids, electrolytes, minerals, vitamins and amino acids. The Q-L-Y conjugates and the parenteral nutrition composition can be administered at the same time, at different times, before, or after each other, provided that the Q-L-Y conjugate is exerting the desired biological effect at the time that the parenteral nutrition composition is being digested. For example, the parenteral nutrition may be administered, 1, 2 or 3 times per day, while the glucagon conjugate is administered once every other day, three times a week, two times a week, once a week, once every 2 weeks, once every 3 weeks, or once a month.

As used herein, the terms "treat," and "prevent" as well as words stemming therefrom, do not necessarily imply 100% or complete treatment or prevention. Rather, there are varying degrees of treatment or prevention of which one of ordinary skill hi the art recognizes as having a potential benefit or therapeutic effect. In this respect, the inventive methods can provide any amount of any level of treatment or prevention of a disease or medical condition in a mammal. Furthermore, the treatment or prevention provided by the method can include treatment or prevention of one or more conditions or symptoms of the disease or medical condition. For example, with regard to methods of treating obesity, the method in some embodiments, achieves a decrease in food intake by or fat levels in a patient. Also, for purposes herein, "prevention" can encompass delaying the onset of the disease, or a symptom or condition thereof.

With regard to the above methods of treatment, the patient is any host. In some embodiments, the host is a mammal. As used herein, the term "mammal" refers to any vertebrate animal of the mammalia class, including, but not limited to, any of the monotreme, marsupial, and placental taxas. In some embodiments, the mammal is one of the mammals of the order Rodentia, such as mice and hamsters, and mammals of the order Logomorpha, such as rabbits. In certain embodiments, the mammals are from the order Carnivora, including Felines (cats) and Canines (dogs). In certain embodiments, the mammals are from the order Artiodactyla, including Bovines (cows) and S wines (pigs) or of the order Perssodactyla, including Equines (horses). In some instances, the mammals are of the order Primates, Ceboids, or Simoids (monkeys) or of the order Anthropoids (humans and apes). In particular embodiments, the mammal is a human.

Combinations

The Q-L-Y conjugates described herein may be administered alone or in combination with other therapeutic agents which aim to treat or prevent any of the diseases or medical conditions described herein. For example, the Q-L-Y conjugates described herein may be co-administered with (simultaneously or sequentially) an anti-diabetic or anti-obesity agent. Anti-diabetic agents known in the art or under investigation include insulin, leptin, Peptide YY (PYY), Pancreatic Peptide (PP), fibroblast growth factor 21 (FGF21), Y2Y4 receptor agonists, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARy inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; glucokinase activators (GKA); glucagon receptor antagonists (GRA); or FBPase (fructose 1,6-bisphosphatase) inhibitors.

Anti-obesity agents known in the art or under investigation include appetite suppressants, including phenethylamine type stimulants, phentermine (optionally with fenfluramine or dexfenfluramine), diethylpropion (Tenuate®), phendimetrazine (Prelu-2®), Bontril®), benzphetamine (Didrex®), sibutramine (Meridia®, Reductil®); rimonabant (Acomplia®), other cannabinoid receptor antagonists; oxyntomodulin; fluoxetine hydrochloride (Prozac); Qnexa (topiramate and phentermine), Excalia (bupropion and zonisamide) or Contrave (bupropion and naltrexone); or lipase inhibitors, similar to XENICAL (Orlistat) or Cetilistat (also known as ATL-962), or GT 389-255.

The Q-L-Y conjugates described herein in some embodiments are co-administered with an agent for treatment of non-alcoholic fatty liver disease or NASH. Agents used to treat non-alcoholic fatty liver disease include ursodeoxycholic acid (a.k.a., Actigall, URSO, and Ursodiol), Metformin (Glucophage), rosiglitazone (Avandia), Clofibrate, Gemfibrozil, Polymixin B, and Betaine.

The Q-L-Y conjugates described herein in some embodiments are co-administered with an agent for treatment of a neurodegenerative disease, e.g., Parkinson's Disease. Anti-Parkinson's Disease agents are furthermore known in the art and include, but not limited to, levodopa, carbidopa, anticholinergics, bromocriptine, pramipexole, and ropinirole, amantadine, and rasagiline.

In view of the foregoing, the invention further provides pharmaceutical compositions and kits additionally comprising one of these other therapeutic agents. The additional therapeutic agent may be administered simultaneously or sequentially with the conjugate of the present disclosure. In some aspects, the conjugate is administered before the additional therapeutic agent, while in other aspects, the conjugate is administered after the additional therapeutic agent.

Kits

The Q-L-Y conjugates of the present disclosure can be provided in accordance with one embodiment as part of a kit. Accordingly, in some embodiments, a kit for administering a Q-L-Y conjugate to a patient in need thereof is provided wherein the kit comprises a Q-L-Y conjugate as described herein.

In one embodiment the kit is provided with a device for administering the Q-L-Y conjugate composition to a patient, e.g. syringe needle, pen device, jet injector or other needle-free injector. The kit may alternatively or in addition include one or more containers, e.g., vials, tubes, bottles, single or multi-chambered pre-filled syringes, cartridges, infusion pumps (external or implantable), jet injectors, pre-filled pen devices and the like, optionally containing the glucagon conjugate in a lyophilized form or in an aqueous solution. The kits in some embodiments comprise instructions for use. In accordance with one embodiment the device of the kit is an aerosol dispensing device, wherein the composition is prepackaged within the aerosol device. In another embodiment the kit comprises a syringe and a needle, and in one embodiment the sterile glucagon composition is prepackaged within the syringe.

The following examples are given merely to illustrate the present invention and not in any way to limit its scope.

EXAMPLES

Example 1

Synthesis of Peptide Fragments of Glucagon Superfamily Peptides

Materials

Peptides are synthesized by any procedures known in the art. Exemplary protocols follow. Peptides can be amidated at the C-terminus. MBHA (4-methylbenzhydrylamine polystyrene) resin can be used during peptide synthesis. MBHA resin, 100-180 mesh, 1% divinylbenzene (DVB) cross-linked polystyrene; loading of 0.7-1.0 mmol/g), Boc-protected (tert-butylcarbamates) and Fmoc protected (9-fluoenylmethyl carbamate) amino acids can be purchased from Midwest Biotech. The solid phase peptide syntheses using Boc-protected amino acids can be performed on an Applied Biosystem 430A Peptide Synthesizer. Fmoc protected amino acid synthesis can be performed using the Applied Biosystems Model 433 Peptide Synthesizer. In specific embodiments, the following procedures can be used:

General Peptide Synthesis Protocol with Boc-Chemistry Strategy

Synthesis of peptides using Boc chemistry can be performed on the Applied Biosystem Model 430A Peptide Synthesizer. Synthetic peptides are constructed by sequential addition of amino acids to a cartridge containing 2 mmol of Boc protected amino acid. Specifically, the synthesis can be carried out using 3-(Diethoxy-phosphoryloxy)-3H-benzo[d][1,2,3]triazin-4-one (DEPBT) or HBTU as the coupling agent with single couplings. At the end of the coupling step, the peptidyl-resin is treated with trifluoroacetic acid (TFA) to remove the N-terminal Boc protecting group. The resin is then washed repeatedly with dimethylformamide (DMF) and this repetitive cycle is repeated for the desired number of coupling steps. Boc amino acids and HBTU can be obtained from Midwest Biotech (Fishers, Ind.). General side chain protecting groups that can be used include: Arg(Tos), Asn (Xan), Asp(OcHex), Cys(pMeBzl), His(Bom), Lys(2Cl-Z), Ser(OBzl), Thr(OBzl), Tyr(2Br-Z), and Trp(CHO). Boc-Glu (OFm)-OH and Boc-Lys(Fmoc)-OH (Chem-Impex, Wood dale, IL) is used in the lactam-bridge formation sites.

After assembly of the peptides, the Fmoc protected side chains are deprotected using 20% piperidine treatment. For the lactamization, orthogonal protecting groups are selected for Glu and Lys (e.g., Glu(Fm), Lys(Fmoc)). After removal of the protecting groups and before HF cleavage, cyclization is performed as described previously (see, e.g., International Patent Application Publication No. WO2008/101017). HF treatment of the peptidyl-resin The peptidyl-resin is treated with anhydrous HF in the presence of p-cresol and dimethyl sulfide, which typically yielded approximately 350 mg (about 50% yield) of a crude deprotected-peptide. Specifically, the peptidyl-resin (30 mg to 200 mg) is placed in a hydrogen fluoride (HF) reaction vessel for cleavage. Then, 500 µL of p-cresol is added to the vessel as a carbonium ion scavenger. The vessel is attached to the HF system and submerged in a methanol/dry ice mixture. The vessel is evacuated with a vacuum pump and 10 mL of HF was distilled into the reaction vessel. This reaction mixture of the peptidyl-resin and the HF was stirred for one hour at 0° C., after which a vacuum was established and the HF is quickly evacuated (10-15 min) The vessel is then removed carefully and filled with approximately 35 mL of ether to precipitate the peptide and to extract the p-cresol and small molecule organic protecting groups resulting from HF treatment. This mixture is filtered utilizing a Teflon filter and repeated twice to remove all excess cresol. This filtrate is discarded. The precipitated peptide is dissolved in approximately 20 mL of 10% acetic acid (aq). This filtrate, which contained the desired peptide, is collected and lyophilized.

An analytical HPLC analysis of the crude solubilized peptide is conducted under the following conditions [4.6×30 mm Xterra C8, 1.50 mL/min, 220 nm, A buffer 0.1% TFA/10% acetonitrile ($CH_3CN$), B buffer 0.1% TFA/100% $CH_3CN$, gradient 5-95% B over 15 minutes]. The extract is diluted twofold with water and loaded onto a 2.2×25 cm Vydac C4 preparative reverse phase column and eluted using an acetonitrile gradient on a Waters HPLC system (A buffer of 0.1% TFA/10% $CH_3CN$, B buffer of 0.1% TFA/10% $CH_3CN$ and a gradient of 0-100% B over 120 minutes at a flow of 15.00 mL/min. HPLC analysis of the purified peptide demonstrated greater than 95% purity and electrospray ionization mass spectral analysis can be used to confirm the identity of the peptide.

General Peptide Synthesis Protocol with Fmoc-Chemistry Strategy:

Peptides can be synthesized on an ABI 433A automated peptide synthesizer using standard Fmoc chemistry with Rink MBHA amide resin or first amino acid attached Wang resin (Novabiochem, San Diego, Calif.) using DIC/HOBT as coupling reagent. The side chain protecting groups of Na-Fmoc [N-(9-fluorenyl)methoxycarbonyl]amino acids that can be used include the following: Arg, Pmc; Asp, OtBu; Cys, Trt; Gln, Trt; His, Trt; Lys, Boc; Ser, tBu, Tyr, tBu; and Trp, Boc (Pmc=2,2,5,7,8-pentamethylchoman-6-sulfonyl, OtBu32 tert-butyl ester, Trt=trityl, Boc32 tert-butyloxycarbonyl, and tBu32 tert-butyl ester). Fmoc-Glu(O-2-PhiPr)-OH and Fmoc-Lys(Mmt)-OH (Novabiochem, San Diego, Calif.) are incorporated in the lactam-bridge formation sites.

After solid phase synthesis, the 2-phenylisopropyl (2-PhiPr) group on the Glu and the 4-methoxytrityl (Mmt) group on the Lys are removed by flashing 1% TFA/DCM though the peptidyl resin. For the lactam-bridge formation, usually 150 mg (0.5 mmole, 5-fold) BEPBT are added in 10% DIEA/DMF and reacted for 2 to 4 h until ninhydrin test shown negative.

Peptides are cleaved from the resin with cleavage cocktail containing 85% TFA, 5% phenol, 5% water and 5% thioanisole (2.5% EDT is added when peptide contains Cysteine). Crude peptides are precipitated in ether, centrifuged, and lyophilized. Peptides are then analyzed by analytical HPLC and checked by ESI or MALDI-TOF mass spectrometry. Peptides are then purified by the general HPLC purification procedure.

Peptide Acylation

Acylated peptides can be prepared as follows. Peptides are synthesized on a solid support resin using either a CS Bio 4886 Peptide Synthesizer or Applied Biosystems 430A Peptide Synthesizer. In situ neutralization chemistry can be used as described by Schnolzer et al., Int. J. Peptide Protein Res. 40: 180-193 (1992). For acylated peptides, the target amino acid residue to be acylated (e.g., position ten, relative to the amino acid position numbering of SEQ ID NO: 1601) is substituted with an Nε-FMOC lysine residue. Treatment of the completed N-terminally BOC protected peptide with 20% piperidine in DMF for 30 minutes is used to remove FMOC/formyl groups. Coupling to the free ε-amino Lys residue is achieved by reacting a ten-fold molar excess of either an FMOC-protected spacer amino acid (ex. FMOC-Glu-OtBu) or acyl chain (e.g. $CH_3(CH_2)_{14}$—COOH) and benzotriazol-1-yl-oxytripyrrolidinophosphonium hexafluorophosphate (PyBOP), N,N'diisopropylcarbodiimide (DIC), or DEPBT coupling reagent in DMF/diisopropylethylamine (DIEA). Subsequent removal of the spacer amino acid's FMOC group is followed by repetition of coupling with an acyl chain. Final treatment with 100% TFA resulted in removal of any side chain protecting groups and the N-terminal BOC group. Peptide resins are neutralized with 5% DIEA/DMF, dried, and then cleaved from the support using HF/p-cresol, 95:5, at 0° C. for one hour. Following ether extraction, a 5% acetic acid (HOAc) solution is used to solvate the crude peptide. A sample of the solution was then verified to contain the correct molecular weight peptide by ESI-MS. Correct peptides are typically purified by reverse phase (RP) HPLC using a linear gradient of 10% $CH_3CN$/0.1% TFA to 0.1% TFA in 100% $CH_3CN$. A Vydac C18 22 mm×250 mm protein column can be used for the purification. Acylated peptide conjugates generally completed elution by a buffer ratio of 20:80. Portions can be pooled together and checked for purity on an analytical RP-HPLC. Pure fractions are lyophilized yielding white, solid peptides.

If a peptide comprised a lactam bridge and target residues to be acylated, acylation can be carried out as described above upon addition of that amino acid to the peptide backbone.

Peptide PEGylation to Form Thioether Linkages

For peptide PEGylation, 40 kDa methoxy poly(ethylene glycol) idoacetamide is reacted with a molar equivalent of peptide in 7M Urea, 50 mM Tris-HCl buffer using the minimal amount of solvent needed to dissolve both peptide and PEG into a clear solution (generally less than 2 mL for a reaction using 2 to 3 mg peptide). Vigorous stirring at room temperature is commenced for 4 to 6 hours and the reaction can be analyzed by analytical RP-HPLC. PEGylated products appeared distinctly from the starting material with decreased retention times. Purification can be performed on a Vydac C4 column with conditions similar to those used for the initial peptide purification. Elution occurrs around buffer ratios of 50:50. Fractions of pure PEGylated peptide are isolated and lyophilized. Yields will be above 50%, varying per reaction.

Peptide PEGylation to Form Maleimido Linkages

For peptide PEGylation, the peptide containing a cysteine is dissolved in phosphate buffered saline (5- to 0 mg/mL) and 0.01 M ethylenediamine tetraacetic acid is added (10-15% of total volume). Excess (2-fold) maleimido methoxyPEG reagent (Dow) is added and the reaction is stirred at room temperature while monitoring reaction progress by high performance liquid chromatography (HPLC). After 8-24 hrs, the reaction mixture is acidified and loaded onto a preparative reverse phase column for purification using 0.1% tetrafluoroacetic acid (TFA)/acetonitrile in the gradient mode. The appropriate fractions are combined and lyophilized to give the desired pegylated derivatives.

Analysis Using Mass Spectrometry

Mass spectra are obtained using a Sciex API-III electrospray quadrapole mass spectrometer with a standard ESI ion source. Ionization conditions that are used are as follows: ESI in the positive-ion mode; ion spray voltage, 3.9 kV; orifice potential, 60 V. The nebulizing and curtain gas used is nitrogen flow rate of 0.9 L/min. Mass spectra are recorded from 600-1800 Thompsons at 0.5 Th per step and 2 msec dwell time. The sample (about 1mg/mL) is dissolved in 50% aqueous acetonitrile with 1% acetic acid and introduced by an external syringe pump at the rate of 5 µL/min When the peptides are analyzed in PBS solution by ESI MS, they are first desalted using a ZipTip solid phase extraction tip containing 0.6 µL C4 resin, according to instructions provided by the manufacturer (Millipore Corporation, Billerica, Mass., see the Millipore website of the world wide web at millipore.com/catalogue.nsf/docs/C5737).

High Performance Liquid Chromatography (HPLC) Analysis:

Preliminary analyses are performed with these crude peptides to get an approximation of their relative conversion rates in Phosphate Buffered Saline (PBS) buffer (pH, 7.2) using high performance liquid chromatography (HPLC) and MALDI analysis. The crude peptide samples are dissolved in the PBS buffer at a concentration of 1 mg/mL. 1 mL of the resulting solution is stored in a 1.5 mL HPLC vial which is then sealed and incubated at 37° C. Aliquots of 100 µl are drawn out at various time intervals, cooled to room temperature and analyzed by HPLC.

The HPLC analyses are performed using a Beckman System Gold Chromatography system using a UV detector at 214 nm HPLC analyses are performed on a 150 mm×4.6 mm C18 Vydac column. The flow rate is 1 mL/min. Solvent A contained 0.1% TFA in distilled water, and solvent B contained 0.1% TFA in 90% $CH_3CN$. A linear gradient is employed (40% to 70% B in 15 minutes). The data are collected and analyzed using Peak Simple Chromatography software.

Example 2

The ability of each peptide to induce cAMP can be measured in a firefly luciferase-based reporter assay. The cAMP production that is induced is directly proportional to the glucagon fragment binding to the glucagon receptor or GIP receptor or GLP-1 receptor. HEK293 cells co-transfected with the receptor and luciferase gene linked to a cAMP responsive element are employed for the bioassay.
The cells are serum-deprived by culturing 16 hours in Dulbecco-modified Minimum Essential Medium (Invitrogen, Carlsbad, Calif.) supplemented with 0.25% Bovine Growth Serum (HyClone, Logan, Utah) and then incubated with serial dilutions of glucagon fragments for 5 hours at 37° C., 5% $CO_2$ in 96 well poly-D-Lysine-coated "Biocoat" plates (BD Biosciences, San Jose, Calif.). At the end of the incubation, 100 µL of LucLite luminescence substrate reagent (Perkin Elmer, Wellesley, Mass.) is added to each well. The plate is shaken briefly, incubated 10 min in the dark and light output was measured on MicroBeta-1450 liquid scintillation counter (Perkin-Elmer, Wellesley, Mass.). The effective 50% concentrations ($EC_{50}$) and inhibitory 50% concentrations ($IC_{50}$) are calculated by using Origin software (OriginLab, Northampton, Mass.).

Example 3

Diet-induced obesity mice are administered subcutaneous injections once per day for two weeks with vehicle or 40 or 400 µg/kg of one of the following:
 (a) GLP-1 agonist,
 (b) GLP-1 agonist stably linked to Y,
 (c) GLP-1 agonist with a labile linkage to Y, or
 (d) GLP-1 agonist with a metastable linkage to Y.
Body weight is measured after 14 days and the change in body weight is determined. Mice that are administered the GLP-1 agonist conjugates experience a greater decrease in body weight than mice that are administered the GLP-1 agonist alone.

The effect of the conjugates on cumulative food intake over a period of 14 days is also determined Mice that are administered the GLP-1 agonist conjugates consume less food than mice that are administered the GLP-1 agonist alone.

The effect of the conjugates on the change in blood glucose is determined. Mice that are administered the GLP-1 agonist conjugates experience a greater decrease in blood glucose levels over the course of the study than mice that are administered the GLP-1 agonist alone.

Example 4

Diet-induced obesity mice are administered subcutaneous injections once per day for two weeks with vehicle or 40 or 400 µg/kg of one of the following:
 (a) GLP-1 agonist,
 (b) GLP-1 agonist stably linked to a β3 adrenergic receptor agonist,
 (c) GLP-1 agonist with a labile linkage to a β3 adrenergic receptor agonist,
 (d) GLP-1 agonist stably linked to a nicotinic acetylcholine receptor agonist, or (e) GLP-1 agonist with a labile linkage to a nicotinic acetylcholine receptor agonist.

Body weight is measured after 14 days and the change in body weight is determined. Mice that are administered the GLP-1 agonist conjugates experience a greater decrease in body weight than mice that are administered the GLP-1 agonist alone.

The effect of the conjugates on cumulative food intake over a period of 14 days is also determined Mice that are administered the GLP-1 agonist conjugates consume less food than mice that are administered the GLP-1 agonist alone.

The effect of the conjugates on the change in blood glucose is determined Mice that are administered the GLP-1 agonist conjugates experience a greater decrease in blood glucose levels over the course of the study than mice that are administered the GLP-1 agonist alone.

SEQUENCE LISTING (1680 sequences)

SEQ ID NO: 1 - protein, 29 aa, Homo sapiens
HSQGTFTSDYSKYLDSRRAQDFVQWLMNT

SEQ ID NO: 2 - protein, 29 aa, Artificial Sequence
  Synthetic Glucagon Analogue
  MOD_RES (16)..(16): Glu, Gln, homoglutamic acid or homocysteic acid
  MOD_RES (17)..(17): Arg, Cys, Orn, homocysteine or acetyl phenylalanine
  MOD_RES (27)..(27): Met, Leu or Nle
HSQGTFTSDYSKYLDXXRAQDFVQWLXNT

SEQ ID NO: 3 - protein, 29 aa, Artificial Sequence
  Synthetic Glucagon Analogue
  MOD_RES (16)..(16): Glu, Gln, homoglutamic acid or homocysteic acid
  MOD_RES (21)..(21): Asp, Cys, Orn, homocysteine or acetyl phenyalanine
  MOD_RES (27)..(27): Met, Leu or Nle
HSQGTFTSDYSKYLDXRRAQXFVQWLXNT

SEQ ID NO: 4 - protein, 29 aa, Artificial Sequence
  Synthetic Glucagon Analogue
  MOD_RES (16)..(16): Glu, Gln, homoglutamic acid or homocysteic acid
  MOD_RES (24)..(24): Gln, Cys, Orn, homocysteine or acetyl phenylalanine
  MOD_RES (27)..(27): Met, Leu or Nle
HSQGTFTSDYSKYLDXRRAQDFVXWLXNT

SEQ ID NO: 5 - protein, 29 aa, Artificial Sequence
  Synthetic Glucagon Analogue
  MOD_RES (16)..(16): Glu, Gln, homoglutamic acid or homocysteic acid
  MOD_RES (21)..(21): Asp, Cys, Orn, homocysteine or acetyl phenyalanine
  MOD_RES (24)..(24): Gln, Cys, Orn, homocysteine or acetyl phenyalanine
  MOD_RES (27)..(27): Met, Leu or Nle
HSQGTFTSDYSKYLDXRRAQXFVXWLXNT

SEQ ID NO: 6 - protein, 29 aa, Artificial Sequence
  Synthetic Glucagon Analogue
  MOD_RES (21)..(21): Asp, Cys, Orn, homocysteine or acetyl phenyalanine
  MOD_RES (27)..(27): Met, Leu or Nle
HSQGTFTSDYSKYLDERRAQXFVQWLXNT

SEQ ID NO: 7 - protein, 29 aa, Artificial Sequence
  Synthetic Glucagon Analogue
  MOD_RES (24)..(24): Gln, Cys, Orn, homocysteine or acetyl phenylalanine
  MOD_RES (27)..(27): Met, Leu or Nle
HSQGTFTSDYSKYLDERRAQDFVXWLXNT

SEQ ID NO: 8 - protein, 29 aa, Artificial Sequence
  Synthetic Glucagon Analogue
  MOD_RES (16)..(16): Glu, Gln, homoglutamic acid or homocysteic acid
HSQGTFTSDYSKYLDXRRAQDFVQWLMNT

SEQ ID NO: 9 - protein, 29 aa, Artificial Sequence
  Synthetic Glucagon Analogue
  MOD_RES (27)..(27): Met, Leu or Nle
HSQGTFTSDYSKYLDERRAQDFVQWLXNT

SEQ ID NO: 10 - protein, 29 aa, Artificial Sequence
  Synthetic Glucagon Analogue
HSQGTFTSDYSKYLDERRAQDFVQWLMNT

SEQ ID NO: 11 - protein, 29 aa, Artificial Sequence
  Synthetic Glucagon Analogue
  MISC_FEATURE: c-term amidation
HSQGTFTSDYSKYLDERRAQDFVQWLMNT

SEQ ID NO: 12 - protein, 29 aa, Artificial Sequence
  Synthetic Glucagon Analogue
  MISC_FEATURE (12)..(16): Lactam ring between side chains at position 12 and 16
HSQGTFTSDYSKYLDERRAQDFVQWLMNT

SEQ ID NO: 13 - protein, 29 aa, Artificial Sequence
  Synthetic Glucagon Analogue
  MISC_FEATURE (16)..(20): Lactam ring between side chains at positions 16 and 20
HSQGTFTSDYSKYLDERRAKDFVQWLMNT

SEQ ID NO: 14 - protein, 29 aa, Artificial Sequence
  Synthetic Glucagon Analogue
  MISC_FEATURE (22)..(24): Lactam ring between side chains at positions 22 and 24
HSQGTFTSDYSKYLDSRRAKDFVEWLMNT

SEQ ID NO: 15 - protein, 29 aa, Artificial Sequence
  Synthetic Glucagon Analogue
  MISC_FEATURE (24)..(28): Lactam ring formed between side chains at positions 24 and 28
HSQGTFTSDYSKYLDSRRAQDFVEWLMKT

SEQ ID NO: 16 - protein, 29 aa, Artificial Sequence
  Synthetic Glucagon Analogue
  MISC_FEATURE (12)..(16): Lactam ring between side chains at positions 12 and 16
  MISC_FEATURE (20)..(24): Lactam ring between side chains at positions 20 and 24
HSQGTFTSDYSKYLDERRAKDFVEWLMNT

SEQ ID NO: 17 - protein, 29 aa, Artificial Sequence
  Synthetic Glucagon Analogue
  MISC_FEATURE (16)..(20): Lactam ring between side chains at positions 16 and 20
  MISC_FEATURE (24)..(28): Lactam ring between side chains at positions 24 and 28
HSQGTFTSDYSKYLDERRADDFVEWLMKT

SEQ ID NO: 18 - protein, 29 aa, Artificial Sequence
  Synthetic Glucagon Analogue
  MISC_FEATURE (16)..(20): Lactam ring between side chains at positions 16 and 20
HSQGTFTSDYSKYLDERRAKDFVEWLMKT

SEQ ID NO: 19 - protein, 30 aa, Artificial Sequence
  Synthetic Glucagon Analogue
  MISC_FEATURE: c-term amidation
  MOD_RES (30)..(30): Variable amino acid
HSQGTFTSDYSKYLDERRAQDFVQWLMNTX

SEQ ID NO: 20 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln, Lys, Arg, Orn or Citrulline
  MOD_RES (24)..(24): Gln or Glu
  MOD_RES (28)..(28): Asn, Asp or Lys
  MOD_RES (29)..(29): Thr or Gly
HSQGTFTSDYSKYLDXRRAXDFVXWLMXX

SEQ ID NO: 21 - protein, 29 aa, Artificial Sequence
  Synthetic Glucagon Analogue
  MISC_FEATURE: c-term amidation
  MOD_RES (2)..(2): Xaa is D-Ser, Ala, Gly, N-methyl Ser or AIB
HXQGTFTSDYSKYLDERRAQDFVQWLMNT

SEQ ID NO: 22 - protein, 29 aa, Artificial Sequence
  Synthetic Glucagon Analogue
  MISC_FEATURE: c-term amidation
  MOD_RES (2)..(2): Xaa is AIB
HXQGTFTSDYSKYLDERRAQDFVQWLMNT

SEQ ID NO: 23 - protein, 29 aa, Artificial Sequence
  Synthetic Glucagon Analogue
  MISC_FEATURE: c-term amidation
  MOD_RES (17)..(17): Cys-PEG
  MOD_RES (27)..(27): Met, Leu or Nle
HSQGTFTSDYSKYLDECRAQDFVQWLXNT

SEQ ID NO: 24 - protein, 29 aa, Artificial Sequence
  Synthetic Glucagon Analogue
  MISC_FEATURE: c-term amidation
  MOD_RES (21)..(21): Cys-PEG
  MOD_RES (27)..(27): Met, Leu or Nle
HSQGTFTSDYSKYLDERRAQCFVQWLXNT

SEQ ID NO: 25 - protein, 29 aa, Artificial Sequence
  Synthetic Glucagon Analogue
  MISC_FEATURE: c-term amidation
  MOD_RES (24)..(24): Cys-PEG
  MOD_RES (27)..(27): Met, Leu or Nle
HSQGTFTSDYSKYLDERRAQDFVCWLXNT

SEQ ID NO: 26 - protein, 10 aa, Artificial Sequence
  Synthetic peptide fragment representing the carboxy terminal 10 amino acids Exendin-4
GPSSGAPPPS

SEQ ID NO: 27 - protein, 8 aa, Artificial Sequence
  Synthetic peptide fragment representing the carboxy terminal 8 amino acids of oxyntomodulin
KRNRNNIA

SEQ ID NO: 28 - protein, 4 aa, Artificial Sequence
  Synthetic peptide
KRNR

SEQ ID NO: 29 - protein, 10 aa, Artificial Sequence
  Synthetic peptide fragment representing the carboxy terminal 10 amino acids of Exendin-4
  MISC_FEATURE: c-term amidation
GPSSGAPPPS

SEQ ID NO: 30 - protein, 39 aa, Artificial Sequence
  Synthetic Glucagon Analogue
  MOD_RES (27)..(27): Met, Leu or Nle
HSQGTFTSDYSKYLDERRAQDFVQWLXNTGPSSGAPPPS

SEQ ID NO: 31 - protein, 37 aa, Artificial Sequence
  Synthetic Glucagon Analogue
  MOD_RES (27)..(27): Met, Leu or Nle
HSQGTFTSDYSKYLDERRAQDFVQWLXNTKRNRNNIA

SEQ ID NO: 32 - protein, 33 aa, Artificial Sequence
  Synthetic Glucagon Analogue
  MOD_RES (27)..(27): Met, Leu or Nle
HSQGTFTSDYSKYLDERRAQDFVQWLXNTKRNR

SEQ ID NO: 33 - protein, 29 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or an acidic amino acid
  MOD_RES (29)..(29): Thr, Gly or an acidic amino acid
HSQGTFTSDYSKYLXXRRAXDFVXWLMXX

SEQ ID NO: 34 - protein, 29 aa, Artificial Sequence
  Synthetic Glucagon Analogue
  MOD_RES (15)..(15): Asp, Glu, cysteic acid, homoglutamic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Asp or Lys
  MOD_RES (29)..(29): Thr or Gly
HSQGTFTSDYSKYLDXRRAXDFVXWLMXX

SEQ ID NO: 35 - protein, 29 aa, Artificial Sequence
  Synthetic Glucagon Analogue
HSQGTFTSDYSKYLDSCRAQDFVQWLMNT

SEQ ID NO: 36 - protein, 39 aa, Artificial Sequence
  Synthetic Glucagon Analogue
HSQGTFTSDYSKYLDSRRAQDFVQWLMNTGPSSGAPPPS

SEQ ID NO: 37 - protein, 29 aa, Artificial Sequence
  Synthetic Glucagon Analogue
  MOD_RES (24)..(24): 2-butyrolactone bound through thiol group of Cys
HSQGTFTSDYSKYLDSRRAQDFVCWLMNT

SEQ ID NO: 38 - protein, 29 aa, Artificial Sequence
  Synthetic Glucagon Analogue
  MOD_RES (24)..(24): Carboxymethyl group bound through thiol group of Cys
HSQGTFTSDYSKYLDSRRAQDFVCWLMNT

SEQ ID NO: 39 - protein, 39 aa, Artificial Sequence
  Synthetic Glucagon Analogue
HSQGTFTSDYSRYLDSRRAQDFVQWLMNTGPSSGAPPPS

SEQ ID NO: 40 - protein, 29 aa, Artificial Sequence
  Synthetic Glucagon Analogue
  MISC_FEATURE: c-term amidation
  MOD_RES (15)..(15): Glu or Asp
  MOD_RES (28)..(28): Glu or Asp
HSQGTFTSDYSKYLXERRAQDFVQWLMXT

SEQ ID NO: 41 - protein, 29 aa, Artificial Sequence
  Synthetic Glucagon Analogue
  MISC_FEATURE: c-term amidation; lactam ring between side chains at positions 12 and 16
  MISC_FEATURE: c-term amidation
  MISC_FEATURE (12)..(16): Lactam ring between side chains at positions 12 and 16
  MOD_RES (15)..(15): Glu or Asp
  MOD_RES (28)..(28): Glu or Asp
HSQGTFTSDYSKYLXERRAQDFVQWLMXT

SEQ ID NO: 42 - protein, 29 aa, Artificial Sequence
  Synthetic Glucagon Analogue
  MISC_FEATURE: c-term amidation; lactam ring between side chains at positions 16 and 20
  MISC_FEATURE: c-term amidation
  MOD_RES (15)..(15): Glu or Asp
  MISC_FEATURE (16)..(20): Lactam ring between side chains at positions 16 and 20
  MOD_RES (28)..(28): Glu or Asp
HSQGTFTSDYSKYLXERRAKDFVQWLMXT

SEQ ID NO: 43 - protein, 29 aa, Artificial Sequence
  Synthetic Glucagon Analogue
  MISC_FEATURE: c-term amidation
  MOD_RES (15)..(15): Glu or Asp
  MISC_FEATURE (20)..(24): Lactam ring between side chains at positions 20 and 24
  MOD_RES (28)..(28): Glu or Asp
HSQGTFTSDYSKYLXSRRAKDFVEWLMXT

SEQ ID NO: 44 - protein, 29 aa, Artificial Sequence
  Synthetic Glucagon Analogue
  MISC_FEATURE: c-term amidation
  MOD_RES (15)..(15): Glu or Asp
  MISC_FEATURE (24)..(28): Lactam ring between side chains at positions 24 and 28
  MOD_RES (29)..(29): Glu or Thr
HSQGTFTSDYSKYLXSRRAQDFVEWLMKX

SEQ ID NO: 45 - protein, 29 aa, Artificial Sequence
  Synthetic Glucagon Analogue
  MOD_RES (12)..(12): Lys or Glu
  MOD_RES (15)..(15): Asp, Glu, homoglutamic acid, cysteic acid or homocysteic acid
  MOD_RES (16)..(16): Ser, Gln, Glu, Lys, homoglutamic acid, cysteic acid or homocysteic acid
  MOD_RES (20)..(20): Gln, Glu or Lys
  MOD_RES (24)..(24): Gln, Lys or Glu
  MOD_RES (28)..(28): Asn, Lys or an acidic amino acid
  MOD_RES (29)..(29): Thr, Gly or an acidic amino acid
HSQGTFTSDYSXYLXXRRAXDFVXWLMXX

SEQ ID NO: 46 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln or Lys
  MOD_RES (24)..(24): Gln or Glu
HSQGTFTSDYSKYLDXRRAXDFVXWLMNT

SEQ ID NO: 47 - protein, 29 aa, Artificial Sequence
  Synthetic Glucagon Analogue
HSQGTFTSDYSKYLDERRAKDFVQWLMNT

SEQ ID NO: 48 - protein, 29 aa, Artificial Sequence
  Synthetic Glucagon Analogue
HSQGTFTSDYSKYLDSRRAKDFVEWLMNT

SEQ ID NO: 49 - protein, 29 aa, Artificial Sequence
  Synthetic Glucagon Analogue
HSQGTFTSDYSKYLDSRRAQDFVEWLMKT

SEQ ID NO: 50 - protein, 31 aa, Homo sapiens
HAEGTFTSDVSSYLEGQAAKEFIAWLVKGRG

SEQ ID NO: 51 - protein, 29 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln, Lys, Arg, Orn, or Citrulline
  MOD_RES (21)..(21): Asp, Glu, homoglutamic acid, or homocysteic acid
  MOD_RES (24)..(24): Gln or Glu
  MOD_RES (28)..(28): Asn, Lys or an acidic amino acid
  MOD_RES (29)..(29): Thr, Gly or an acidic amino acid
HSQGTFTSDYSKYLXXRRAXXFVXWLMXX

SEQ ID NO: 52 - protein, 30 aa, Artificial Sequence
  Synthetic peptide
  MISC_FEATURE: c-term amidation
HAEGTFTSDVSSYLEGQAAKEFIAWLVKGR

SEQ ID NO: 53 - protein, 29 aa, Artificial Sequence
  Synthetic Glucagon Analogue
  MOD_RES (3)..(3): Glu, Orn or Nle
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or an acidic amino acid
  MOD_RES (29)..(29): Thr or an acidic amino acid
HSXGTFTSDYSKYLXXRRAXDFVXWLMXX

SEQ ID NO: 54 - protein, 29 aa, Artificial Sequence
  Synthetic Glucagon Analogue
  MOD_RES (17)..(17): Arg or Gln
  MOD_RES (18)..(18): Arg or Ala
  MOD_RES (21)..(21): Asp or Glu
  MOD_RES (23)..(23): Val or Ile
  MOD_RES (24)..(24): Gln or Ala
HSQGTFTSDYSKYLDEXXAKXFXXWLMNT

SEQ ID NO: 55 - protein, 29 aa, Artificial Sequence
  Synthetic Glucagon Analogue
  MOD_RES (1)..(1): His, D-His, (Des-amino)His, hydroxyl-His, acetyl-His, homo-His or alpha, alpha-dimethyl imidiazole acetic acid (DMIA), N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (10)..(10): Tyr or Trp
  MOD_RES (12)..(12): Lys, Citrulline, Orn or Arg
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (17)..(17): Arg, Gln, Lys, Cys, Orn, homocysteine or acetyl phenylalanine
  MOD_RES (18)..(18): Arg, Ala, Lys, Cys, Orn, homocysteine or acetyl phenyalanine
  MOD_RES (20)..(20): Gln, Lys, Arg, Orn or Citrulline
  MOD_RES (21)..(21): Gln, Glu, Asp, Lys, Cys, Orn, homocystein or acetyl phenyalanine
  MOD_RES (23)..(23): Val or Ile
  MOD_RES (24)..(24): Ala, Gln, Glu, Lys, Cys, Orn, homocysteine or acetyl phenyalanine
  MOD_RES (27)..(27): Met, Leu or Nle
  MOD_RES (28)..(28): Asn, Arg, Citrulline, Orn, Lys or Asp
  MOD_RES (29)..(29): Thr, Gly, Lys, Cys, Orn, homocycsteine or acetyl phenyalanine
XXXGTFTSDXSXYLXXXXAXXFXXWLXXX

SEQ ID NO: 56 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (20)..(20): Gln, Lys, Arg, Orn or Citrulline
  MOD_RES (21)..(21): Gln, Glu, Asp, Cys, Orn, homocycstein or acetyl phenyalanine
  MOD_RES (23)..(23): Val or Ile
  MOD_RES (24)..(24): Ala, Gln, Glu, Cys, Orn, homocycsteine or acetyl phenyalanine
  MOD_RES (27)..(27): Met, Leu or Nle
  MOD_RES (28)..(28): Asn, Lys or Asp
  MOD_RES (29)..(29): Thr, Gly, Lys, Cys, Orn, homocycsteine or acetyl phenyalanine
XXXGTFTSDYSKYLXXRRAXXFXXWLXXX

SEQ ID NO: 57 - protein, 29 aa, Artificial Sequence
  Synthetic Glucagon Analogue
  MOD_RES (1)..(1): His, D-His, (Des-amino)His, hydroxyl-His, acetyl- His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MISC_FEATURE (12)..(16): Lactam ring between side changes at position 12 and 16
  MOD_RES (15)..(15): Asp, Glu, cysteic acid, homoglutamic acid and homocysteic acid
  MOD_RES (20)..(20): Gln, Lys, Arg, Orn or Citrulline
  MOD_RES (21)..(21): Gln, Glu, Asp, Cys, Orn, homocycsteine or acetyl phenyalanine
  MOD_RES (23)..(23): Val or Ile
  MOD_RES (24)..(24): Ala, Gln, Glu, Lys, Cys, Orn, homocysteine or acetyl Phe
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl phenyalanine
XXXGTFTSDYSKYLXERRAXXFXXWLXXX

SEQ ID NO: 58 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or Nle
  MOD_RES (15)..(15): Asp, Glu, cysteic acid, homoglutamic acid or homocysteic acid
  MISC_FEATURE (16)..(20): Lactam ring between side chains at positions 16 and 20
  MOD_RES (21)..(21): Gln, Glu, Asp, Lys, Cys, Orn, homocysteine or acetyl phenyalanine
  MOD_RES (23)..(23): Val or Ile
  MOD_RES (24)..(24): Ala, Gln, Glu, Lys, Cys, Orn, homocysteine or acetyl phenyalanine
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl phenyalanine
XXXGTFTSDYSKYLXERRAKXFXXWLXXX

SEQ ID NO: 59 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB, or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MISC_FEATURE (20)..(24): Lactam ring between side chains at position 20 and 24
  MOD_RES (21)..(21): Gln, Glu, Asp, Lys, Cys, Orn, homocysteine or acetyl phenyalanine
  MOD_RES (23)..(23): Val or Ile
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl pheylalanine
XXXGTFTSDYSKYLXXRRAKXFXEWLXXX

SEQ ID NO: 60 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (20)..(20): Gln, Lys, Arg, Orn, or Citrulline
  MOD_RES (21)..(21): Gln, Glu, Asp, Lys, Cys, Orn, homocysteine or acetyl phenyalanine
  MOD_RES (23)..(23): Val or Ile
  MISC_FEATURE (24)..(28): Lactam ring between side chains at position 24 and 28
  MOD_RES (27)..(27): Met, Leu or Nle
  MOD_RES (29)..(29): Thr, Gly, Lys, Cys, Orn, homocysteine or acetyl phenyalanine
XXXGTFTSDYSKYLXXRRAXXFXEWLXKX

SEQ ID NO: 61 - protein, 40 aa, Artificial Sequence
  Synthetic Glucagon Analogue
  MISC_FEATURE: positions 30 to 40 are present only if position 29 is Gly; see specification as filed for detailed description of substitutions and preferred embodiments
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, Val, Gly, N-methyl Ser, Aib, N-methyl, Ala or D-Ala
  MOD_RES (18)..(18): Ala or Arg
  MOD_RES (24)..(24): Ala, Gln or Cys-PEG
  MOD_RES (29)..(29): Thr-CONH2, Cys-PEG, or Gly
  MOD_RES (40)..(40): Cys-PEG or not present
XXQGTFTSDYSKYLDERXAKDFVXWLMNXGPSSGAPPPSC

SEQ ID NO: 62 - protein, 40 aa, Artificial Sequence
  Synthetic Glucagon Analogue
  MISC_FEATURE: positions 30 to 40 are present only if position 29 is Gly; see specification as filed for detailed description of substitutions and preferred embodiments
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, Val, Gly, N-methyl Ser, AIB0, N-methyl Ala, or D-Ala
  MOD_RES (18)..(18): Ala or Arg
  MOD_RES (24)..(24): Ala, Gln or Cys-PEG
  MOD_RES (29)..(29): Thr-CONH2, Cys-PEG, or Gly
  MOD_RES (40)..(40): Cys-PEG or not present
XXQGTFTSDYSKYLDEQXAKEFIXWLMNXGPSSGAPPPSC

SEQ ID NO: 63 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln or Lys
  MOD_RES (21)..(21): Asp, Lys, Cys, Orn, homocysteine or acetyl phealanine
  MOD_RES (24)..(24): Gln, Lys, Cys, Orn, homocysteine or acetyl phealanine
  MOD_RES (27)..(27): Met, Leu or Nle
HSQGTFTSDYSKYLDXRRAXXFVXWLXNT

SEQ ID NO: 64 - protein, 38 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or Asp
HSQGTFTSDYSKYLXXRRAXDFVXWLMXGGPSSGPPPS

SEQ ID NO: 65 - protein, 11 aa, Artificial Sequence
  Synthetic peptide fragment representing the carboxy terminal 10 amino acids of Exdendin-4
  MOD_RES (11)..(11): Cys-PEG
GPSSGAPPPSC

SEQ ID NO: 66 - protein, 29 aa, Artificial Sequence
  Synthetic Glucagon Analogue
  MISC_FEATURE (12)..(16): Lactam ring between side chains at positions 12 and 16
  MOD_RES (28)..(28): Asp or Asn
  MOD_RES (29)..(29): Thr or Gly
HSQGTFTSDYSKYLDERRAQDFVQWLMXX

SEQ ID NO: 67 - protein, 29 aa, Artificial Sequence
  Synthetic Glucagon Analogue
  MISC_FEATURE (16)..(20): Lactam ring between side chains at positions 16 and 20
  MOD_RES (28)..(28): Asp or Asn
  MOD_RES (29)..(29): Thr or Gly
HSQGTFTSDYSKYLDERRAKDFVQWLMXX

SEQ ID NO: 68 - protein, 29 aa, Artificial Sequence
  Synthetic Glucagon Analogue
  MISC_FEATURE (20)..(24): Lactam ring between side chains at positions 20 and 24
  MOD_RES (28)..(28): Asp or Asn
  MOD_RES (29)..(29): Thr or Gly
HSQGTFTSDYSKYLDSRRAKDFVEWLMXX

SEQ ID NO: 69 - protein, 29 aa, Artificial Sequence
  glucagon analogue
  MISC_FEATURE (24)..(28): Lactam ring between side chains at positions 24 and 28
  MOD_RES (29)..(29): Thr or Gly
HSQGTFTSDYSKYLDSRRAQDFVEWLMKX

SEQ ID NO: 70 - protein, 29 aa, Artificial Sequence
  Synthetic peptide
  MISC_FEATURE: c-term amidation
HSQGTFTSDYSKYLDERRAQDFVQWLMNT

SEQ ID NO: 71 - protein, 29 aa, Artificial Sequence
  Synthetic peptide
  MISC_FEATURE: c-term amidation
HSQGTFTSDYSKYLDERRAKDFVQWLMNT

SEQ ID NO: 72 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDERRAKDFVQWLMNT

SEQ ID NO: 73 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAQDFVQWLMNT

SEQ ID NO: 74 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAKDFVQWLMNT

SEQ ID NO: 75 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRRAEDFVQWLMNT

SEQ ID NO: 76 - protein, 29 aa, Artificial Sequence
  Synthetic peptide
  MISC_FEATURE: c-term amidation
HSQGTFTSDYSKYLDERAAKDFVQWLMNT

SEQ ID NO: 77 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDERAAKDFVQWLMNT

SEQ ID NO: 78 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDERAAQDFVQWLMNT

SEQ ID NO: 79 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDERAAKDFVQWLMNT

SEQ ID NO: 80 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDKRAAEDFVQWLMNT

SEQ ID NO: 81 - protein, 29 aa, Artificial Sequence
  Synthetic Polypeptide
  MISC_FEATURE: c-term amidation
HSQGTFTSDYSKYLDEQAAKEFIAWLMNT

SEQ ID NO: 82 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDEQAAKEFIAWLMNT

SEQ ID NO: 83 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDEQAAKEFIAWLMNT

SEQ ID NO: 84 - protein, 29 aa, Artificial Sequence
  Synthetic Polypeptide
  MISC_FEATURE: c-term amidation
HSQGTFTSDYSKYLDEQAAKEFIAWLVKG

SEQ ID NO: 85 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDEQAAKEFIAWLVKG

SEQ ID NO: 86 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDEQAAKEFIAWLVKG

SEQ ID NO: 87 - protein, 29 aa, Artificial Sequence
  Synthetic Polypeptide
  MISC_FEATURE: c-term amidation
  MOD_RES (1)..(1): (Des-amino)His
XSQGTFTSDYSKYLDERRAQDFVQWLMNT

SEQ ID NO: 88 - protein, 29 aa, Artificial Sequence
  Synthetic Polypeptide
  MISC_FEATURE: c-term amidation
  MOD_RES (1)..(1): (Des-amino)His
XSQGTFTSDYSKYLDERRAKDFVQWLMNT

SEQ ID NO: 89 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERRAKDFVQWLMNT

SEQ ID NO: 90 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMNT

SEQ ID NO: 91 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAKDFVQWLMNT

SEQ ID NO: 92 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMNT

SEQ ID NO: 93 - protein, 29 aa, Artificial Sequence
  Synthetic Polypeptide
  MOD_RES (1)..(1): (Des-amino)His
  MISC_FEATURE (29)..(29): c-term amidation
XSQGTFTSDYSKYLDERAAKDFVQWLMNT

SEQ ID NO: 94 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMNT

SEQ ID NO: 95 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMNT

SEQ ID NO: 96 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMNT

SEQ ID NO: 97 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMNT

SEQ ID NO: 98 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 99 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 100 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMNT

SEQ ID NO: 101 - protein, 29 aa, Artificial Sequence
  Synthetic Polypeptide
  MISC_FEATURE: c-term amidation
  MOD_RES (1)..(1): (Des-amino)His
XSQGTFTSDYSKYLDEQAAKEFIAWLVKG

SEQ ID NO: 102 - protein, 29 aa, Artificial Sequence
  Synthetic Polypeptide
  MISC_FEATURE: C-terminal amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLVKG

SEQ ID NO: 103 - protein, 29 aa, Artificial Sequence
  Synthetic Polypeptide
  MISC_FEATURE: C-terminal amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLVKG

SEQ ID NO: 104 - protein, 29 aa, Artificial Sequence
  Synthetic Polypeptide
  MOD_RES (2)..(2): Xaa is AIB
  MOD_RES (29)..(29): C-terminal amidation
HXQGTFTSDYSKYLDERRAQDFVQWLMNT

SEQ ID NO: 105 - protein, 29 aa, Artificial Sequence
  Synthetic Polypeptide
  MOD_RES (2)..(2): Xaa is AIB
  MISC_FEATURE (16)..(20): Lactam ring between side chains at positions 16 and 20
  MOD_RES (29)..(29): C-terminal amidation
HXQGTFTSDYSKYLDERRAKDFVQWLMNT

SEQ ID NO: 106 - protein, 29 aa, Artificial Sequence
  Synthetic Polypeptide
  MOD_RES (2)..(2): Xaa is AIB
  MISC_FEATURE (16)..(20): Lactam ring between side chains at positions 16 and 20
  MOD_RES (29)..(29): C-terminal amidation
HXQGTFTSDYSKYLDERRAKDFVQWLMNT

SEQ ID NO: 107 - protein, 29 aa, Artificial Sequence
  Synthetic Polypeptide
  MOD_RES (2)..(2): Xaa is AIB
  MISC_FEATURE (12)..(16): Lactam ring between side chains at positions 12 and 16
  MOD_RES (29)..(29): C-terminal amidation
HXQGTFTSDYSKYLDERRAQDFVQWLMNT

SEQ ID NO: 108 - protein, 29 aa, Artificial Sequence
  Synthetic Polypeptide
  MOD_RES (2)..(2): Xaa is AIB
  MISC_FEATURE (12)..(16): Lactam ring between side chains at positions 12 and 16
  MOD_RES (29)..(29): C-terminal amidation
HXQGTFTSDYSKYLDERRAKDFVQWLMNT

SEQ ID NO: 109 - protein, 29 aa, Artificial Sequence
  Synthetic Polypeptide
  MOD_RES (2)..(2): Xaa is AIB
  MISC_FEATURE (16)..(20): Lactam ring between side chains at positions 16 and 20
  MOD_RES (29)..(29): C-terminal amidation
HXQGTFTSDYSKYLDKRRAEDFVQWLMNT

SEQ ID NO: 110 - protein, 29 aa, Artificial Sequence
  Synthetic Polypeptide
  MOD_RES (2)..(2): Xaa is AIB
  MOD_RES (29)..(29): C-terminal amidation
HXQGTFTSDYSKYLDERAAKDFVQWLMNT

SEQ ID NO: 111 - protein, 29 aa, Artificial Sequence
  Synthetic Polypeptide
  MOD_RES (2)..(2): Xaa is AIB
  MISC_FEATURE (16)..(20): Lactam ring between side chains at positions 16 and 20
  MOD_RES (29)..(29): C-terminal amidation
HXQGTFTSDYSKYLDERAAKDFVQWLMNT

SEQ ID NO: 112 - protein, 29 aa, Artificial Sequence
  Synthetic Polypeptide
  MOD_RES (2)..(2): Xaa is AIB
  MISC_FEATURE (12)..(16): Lactam ring between side chains at positions 12 and 16
  MOD_RES (29)..(29): C-terminal amidation
HXQGTFTSDYSKYLDERAAQDFVQWLMNT

SEQ ID NO: 113 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXQGTFTSDYSKYLDERAAKDFVQWLMNT

SEQ ID NO: 114 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXQGTFTSDYSKYLDKRAAEDFVQWLMNT

SEQ ID NO: 115 - protein, 29 aa, Artificial Sequence
  glucagon analog
  MOD_RES (2)..(2): Xaa is AIB
  MOD_RES (29)..(29): C-terminal amidation
HXQGTFTSDYSKYLDEQAAKEFIAWLMNT

SEQ ID NO: 116 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXQGTFTSDYSKYLDEQAAKEFIAWLMNT

SEQ ID NO: 117 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXQGTFTSDYSKYLDEQAAKEFIAWLMNT

SEQ ID NO: 118 - protein, 29 aa, Artificial Sequence
  glucagon analog
  MOD_RES (2)..(2): Xaa is AIB
  MOD_RES (29)..(29): C-terminal amidation
HXQGTFTSDYSKYLDEQAAKEFIAWLVKG

SEQ ID NO: 119 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXQGTFTSDYSKYLDEQAAKEFIAWLVKG

SEQ ID NO: 120 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXQGTFTSDYSKYLDEQAAKEFIAWLVKG

SEQ ID NO: 121 - protein, 29 aa, Artificial Sequence
  glucagon analog
  MOD_RES (2)..(2): D-Ala
  MOD_RES (29)..(29): C-terminal amidation
HXQGTFTSDYSKYLDERRAQDFVQWLMNT

SEQ ID NO: 122 - protein, 29 aa, Artificial Sequence
  glucagon analog
  MOD_RES (2)..(2): D-Ala
  MOD_RES (29)..(29): C-terminal amidation
HXQGTFTSDYSKYLDERRAKDFVQWLMNT

SEQ ID NO: 123 - protein, 29 aa, Artificial Sequence
  glucagon analog
  MOD_RES (2)..(2): D-Ala
  MISC_FEATURE (16)..(20): Lactam ring between side chains at positions 16 and 20
  MOD_RES (29)..(29): C-terminal amidation
HXQGTFTSDYSKYLDERRAKDFVQWLMNT

SEQ ID NO: 124 - protein, 29 aa, Artificial Sequence
  glucagon analog
  MOD_RES (2)..(2): D-Ala
  MISC_FEATURE (12)..(16): Lactam ring between side chains at positions 12 and 16
  MOD_RES (29)..(29): C-terminal amidation
HXQGTFTSDYSKYLDERRAQDFVQWLMNT

SEQ ID NO: 125 - protein, 29 aa, Artificial Sequence
  glucagon analog
  MOD_RES (2)..(2): D-Ala
  MISC_FEATURE (12)..(16): Lactam ring between side chains at positions 12 and 16
  MOD_RES (29)..(29): C-terminal amidation
HXQGTFTSDYSKYLDERRAKDFVQWLMNT

SEQ ID NO: 126 - protein, 29 aa, Artificial Sequence
  glucagon analog
  MOD_RES (2)..(2): D-Ala
  MISC_FEATURE (16)..(20): Lactam ring between side chains at positions 16 and 20
  MOD_RES (29)..(29): C-terminal amidation
HXQGTFTSDYSKYLDKRRAEDFVQWLMNT

SEQ ID NO: 127 - protein, 29 aa, Artificial Sequence
  glucagon analog
  MOD_RES (2)..(2): D-Ala
  MOD_RES (29)..(29): C-terminal amidation
HXQGTFTSDYSKYLDERAAKDFVQWLMNT

SEQ ID NO: 128 - protein, 29 aa, Artificial Sequence
  glucagon analog
  MOD_RES (2)..(2): D-Ala
  MISC_FEATURE (16)..(20): Lactam ring between side chains at positions 16 and 20
  MOD_RES (29)..(29): C-terminal amidation
HXQGTFTSDYSKYLDERAAKDFVQWLMNT

SEQ ID NO: 129 - protein, 29 aa, Artificial Sequence
  glucagon analog
  MOD_RES (2)..(2): D-Ala
  MISC_FEATURE (12)..(16): Lactam ring between side chains at positions 12 and 16
  MOD_RES (29)..(29): C-terminal amidation
HXQGTFTSDYSKYLDERAAQDFVQWLMNT

SEQ ID NO: 130 - protein, 29 aa, Artificial Sequence
  glucagon analog
  MOD_RES (2)..(2): D-Ala
  MISC_FEATURE (12)..(16): Lactam ring between side chains at positions 12 and 16
  MOD_RES (29)..(29): C-terminal amidation
HXQGTFTSDYSKYLDERAAKDFVQWLMNT

SEQ ID NO: 131 - protein, 29 aa, Artificial Sequence
  glucagon analog
  MOD_RES (2)..(2): D-Ala
  MISC_FEATURE (16)..(20): Lactam ring between side chains at positions 16 and 20
  MOD_RES (29)..(29): C-terminal amidation
HXQGTFTSDYSKYLDKRAAEDFVQWLMNT

SEQ ID NO: 132 - protein, 29 aa, Artificial Sequence
  glucagon analog
  MOD_RES (2)..(2): D-Ala
  MOD_RES (29)..(29): C-terminal amidation
HXQGTFTSDYSKYLDEQAAKEFIAWLMNT

SEQ ID NO: 133 - protein, 29 aa, Artificial Sequence
  glucagon analog
  MOD_RES (2)..(2): D-Ala
  MISC_FEATURE (12)..(16): Lactam ring between side chains at positions 12 and 16
  MOD_RES (29)..(29): C-terminal amidation
HXQGTFTSDYSKYLDEQAAKEFIAWLMNT

SEQ ID NO: 134 - protein, 29 aa, Artificial Sequence
  glucagon analog
  MOD_RES (2)..(2): D-Ala
  MISC_FEATURE (16)..(20): Lactam ring between side chains at positions 16 and 20
  MOD_RES (29)..(29): C-terminal amidation
HXQGTFTSDYSKYLDEQAAKEFIAWLMNT

SEQ ID NO: 135 - protein, 29 aa, Artificial Sequence
  glucagon analog
  MOD_RES (2)..(2): D-Ala
  MOD_RES (29)..(29): C-terminal amidation
HXQGTFTSDYSKYLDEQAAKEFIAWLVKG

SEQ ID NO: 136 - protein, 29 aa, Artificial Sequence
  glucagon analog
  MOD_RES (2)..(2): D-Ala
  MISC_FEATURE (12)..(16): Lactam ring between side chains at positions 12 and 16
  MOD_RES (29)..(29): C-terminal amidation
HXQGTFTSDYSKYLDEQAAKEFIAWLVKG

SEQ ID NO: 137 - protein, 29 aa, Artificial Sequence
  glucagon analog
  MOD_RES (2)..(2): D-Ala
  MISC_FEATURE (16)..(20): Lactam ring between side chains at positions 16 and 20
  MOD_RES (29)..(29): C-terminal amidation
HXQGTFTSDYSKYLDEQAAKEFIAWLVKG

SEQ ID NO: 138 - protein, 29 aa, Artificial Sequence
  glucagon analog
  MOD_RES (29)..(29): C-terminal amidation
HSEGTFTSDYSKYLDERRAQDFVQWLMNT

SEQ ID NO: 139 - protein, 29 aa, Artificial Sequence
  glucagon analog
  MOD_RES (29)..(29): C-terminal amidation
HSEGTFTSDYSKYLDERRAKDFVQWLMNT

SEQ ID NO: 140 - protein, 29 aa, Artificial Sequence
  glucagon analog
  MISC_FEATURE (16)..(20): Lactam ring between side chains at positions 16 and 20
  MOD_RES (29)..(29): C-terminal amidation
HSEGTFTSDYSKYLDERRAKDFVQWLMNT

SEQ ID NO: 141 - protein, 29 aa, Artificial Sequence
  glucagon analog
  MISC_FEATURE (12)..(16): Lactam ring between side chains at positions 12 and 16
  MOD_RES (29)..(29): C-terminal amidation
HSEGTFTSDYSKYLDERRAQDFVQWLMNT

SEQ ID NO: 142 - protein, 29 aa, Artificial Sequence
  glucagon analog
  MISC_FEATURE (12)..(16): Lactam ring between side chains at positions 12 and 16
  MOD_RES (29)..(29): C-terminal amidation
HSEGTFTSDYSKYLDERRAKDFVQWLMNT

SEQ ID NO: 143 - protein, 29 aa, Artificial Sequence
  glucagon analog
  MISC_FEATURE (16)..(20): Lactam ring between side chains at positions 16 and 20
  MOD_RES (29)..(29): C-terminal amidation
HSEGTFTSDYSKYLDKRRAEDFVQWLMNT

SEQ ID NO: 144 - protein, 29 aa, Artificial Sequence
  glucagon analog
  MOD_RES (29)..(29): C-terminal amidation
HSEGTFTSDYSKYLDERAAKDFVQWLMNT

SEQ ID NO: 145 - protein, 29 aa, Artificial Sequence
  glucagon analog
  MISC_FEATURE (16)..(20): Lactam ring between side chains at positions 16 and 20
  MOD_RES (29)..(29): C-terminal amidation
HSEGTFTSDYSKYLDERAAKDFVQWLMNT

SEQ ID NO: 146 - protein, 29 aa, Artificial Sequence
  glucagon analog
  MISC_FEATURE (12)..(16): Lactam ring between side chains at positions 12 and 16
  MOD_RES (29)..(29): C-terminal amidation
HSEGTFTSDYSKYLDERAAQDFVQWLMNT

SEQ ID NO: 147 - protein, 29 aa, Artificial Sequence
  glucagon analog
  MISC_FEATURE (12)..(16): Lactam ring between side chains at positions 12 and 16
  MOD_RES (29)..(29): C-terminal amidation
HSEGTFTSDYSKYLDERAAKDFVQWLMNT

SEQ ID NO: 148 - protein, 29 aa, Artificial Sequence
  glucagon analog
  MISC_FEATURE (16)..(20): Lactam ring between side chains at positions 16 and 20
  MOD_RES (29)..(29): C-terminal amidation
HSEGTFTSDYSKYLDKRAAEDFVQWLMNT

SEQ ID NO: 149 - protein, 29 aa, Artificial Sequence
  glucagon analog
  MOD_RES (29)..(29): C-terminal amidation
HSEGTFTSDYSKYLDEQAAKEFIAWLMNT

SEQ ID NO: 150 - protein, 29 aa, Artificial Sequence
  glucagon analog
  MISC_FEATURE (12)..(16): Lactam ring between side chains at positions 12 and 16
  MOD_RES (29)..(29): C-terminal amidation
HSEGTFTSDYSKYLDEQAAKEFIAWLMNT

SEQ ID NO: 151 - protein, 29 aa, Artificial Sequence
  glucagon analog
  MISC_FEATURE (16)..(20): Lactam ring between side chains at positions 16 and 20
  MOD_RES (29)..(29): C-terminal amidation
HSEGTFTSDYSKYLDEQAAKEFIAWLMNT

SEQ ID NO: 152 - protein, 29 aa, Artificial Sequence
  glucagon analog
  MOD_RES (29)..(29): C-terminal amidation
HSEGTFTSDYSKYLDEQAAKEFIAWLVKG

SEQ ID NO: 153 - protein, 29 aa, Artificial Sequence
  glucagon analog
  MISC_FEATURE (12)..(16): Lactam ring between side chains at positions 12 and 16
  MOD_RES (29)..(29): C-terminal amidation
HSEGTFTSDYSKYLDEQAAKEFIAWLVKG

SEQ ID NO: 154 - protein, 29 aa, Artificial Sequence
  glucagon analog
  MISC_FEATURE (16)..(20): Lactam ring between side chains at positions 16 and 20
  MOD_RES (29)..(29): C-terminal amidation
HSEGTFTSDYSKYLDEQAAKEFIAWLVKG

SEQ ID NO: 155 - protein, 29 aa, Artificial Sequence
  glucagon analog
  MOD_RES (1)..(1): (Des-amino)His
  MOD_RES (29)..(29): C-terminal amidation
XSEGTFTSDYSKYLDERRAQDFVQWLMNT

SEQ ID NO: 156 - protein, 29 aa, Artificial Sequence
  glucagon analog
  MOD_RES (1)..(1): (Des-amino)His
  MOD_RES (29)..(29): C-terminal amidation
XSEGTFTSDYSKYLDERRAKDFVQWLMNT

SEQ ID NO: 157 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (29)..(29): C-terminal amidation
XSEGTFTSDYSKYLDERRAKDFVQWLMNT

SEQ ID NO: 158 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (29)..(29): C-terminal amidation
XSEGTFTSDYSKYLDERRAQDFVQWLMNT

SEQ ID NO: 159 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (29)..(29): C-terminal amidation
XSEGTFTSDYSKYLDERRAKDFVQWLMNT

SEQ ID NO: 160 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (29)..(29): C-terminal amidation
XSEGTFTSDYSKYLDKRRAEDFVQWLMNT

SEQ ID NO: 161 - protein, 29 aa, Artificial Sequence
  glucagon analog
  MOD_RES (1)..(1): (Des-amino)His
  MOD_RES (29)..(29): C-terminal amidation
XSEGTFTSDYSKYLDERAAKDFVQWLMNT

SEQ ID NO: 162 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (29)..(29): C-terminal amidation
XSEGTFTSDYSKYLDERAAKDFVQWLMNT

SEQ ID NO: 163 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (29)..(29): C-terminal amidation
XSEGTFTSDYSKYLDERAAQDFVQWLMNT

SEQ ID NO: 164 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (29)..(29): C-terminal amidation
XSEGTFTSDYSKYLDERAAKDFVQWLMNT

SEQ ID NO: 165 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (29)..(29): C-terminal amidation
XSEGTFTSDYSKYLDKRAAEDFVQWLMNT

SEQ ID NO: 166 - protein, 29 aa, Artificial Sequence
  glucagon analog
  MOD_RES (1)..(1): (Des-amino)His
  MOD_RES (29)..(29): C-terminal amidation
XSEGTFTSDYSKYLDEQAAKEFIAWLMNT

SEQ ID NO: 167 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (29)..(29): C-terminal amidation
XSEGTFTSDYSKYLDEQAAKEFIAWLMNT

SEQ ID NO: 168 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (29)..(29): C-terminal amidation
XSEGTFTSDYSKYLDEQAAKEFIAWLMNT

SEQ ID NO: 169 - protein, 29 aa, Artificial Sequence
  glucagon analog
  MOD_RES (1)..(1): (Des-amino)His
  MOD_RES (29)..(29): C-terminal amidation
XSEGTFTSDYSKYLDEQAAKEFIAWLVKG

SEQ ID NO: 170 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (29)..(29): C-terminal amidation
XSEGTFTSDYSKYLDEQAAKEFIAWLVKG

SEQ ID NO: 171 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (29)..(29): C-terminal amidation
XSEGTFTSDYSKYLDEQAAKEFIAWLVKG

SEQ ID NO: 172 - protein, 29 aa, Artificial Sequence
  glucagon analog
  MOD_RES (2)..(2): Xaa is AIB
  MOD_RES (29)..(29): C-terminal amidation
HXEGTFTSDYSKYLDERRAQDFVQWLMNT

SEQ ID NO: 173 - protein, 29 aa, Artificial Sequence
  glucagon analog
  MOD_RES (2)..(2): Xaa is AIB
  MOD_RES (29)..(29): C-terminal amidation
HXEGTFTSDYSKYLDERRAKDFVQWLMNT

SEQ ID NO: 174 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXEGTFTSDYSKYLDERRAKDFVQWLMNT

SEQ ID NO: 175 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXEGTFTSDYSKYLDERRAQDFVQWLMNT

SEQ ID NO: 176 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXEGTFTSDYSKYLDERRAKDFVQWLMNT

SEQ ID NO: 177 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXEGTFTSDYSKYLDKRRAEDFVQWLMNT

SEQ ID NO: 178 - protein, 29 aa, Artificial Sequence
  glucagon analog
  MOD_RES (2)..(2): Xaa is AIB
  MOD_RES (29)..(29): C-terminal amidation
HXEGTFTSDYSKYLDERAAKDFVQWLMNT

SEQ ID NO: 179 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXEGTFTSDYSKYLDERAAKDFVQWLMNT

SEQ ID NO: 180 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXEGTFTSDYSKYLDERAAQDFVQWLMNT

SEQ ID NO: 181 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXEGTFTSDYSKYLDERAAKDFVQWLMNT

SEQ ID NO: 182 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXEGTFTSDYSKYLDKRAAEDFVQWLMNT

SEQ ID NO: 183 - protein, 29 aa, Artificial Sequence
  glucagon analog
  MOD_RES (2)..(2): Xaa is AIB
  MOD_RES (29)..(29): C-terminal amidation
HXEGTFTSDYSKYLDEQAAKEFIAWLMNT

SEQ ID NO: 184 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXEGTFTSDYSKYLDEQAAKEFIAWLMNT

SEQ ID NO: 185 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXEGTFTSDYSKYLDEQAAKEFIAWLMNT

SEQ ID NO: 186 - protein, 29 aa, Artificial Sequence
  glucagon analog
  MOD_RES (2)..(2): Xaa is AIB
  MOD_RES (29)..(29): C-terminal amidation
HXEGTFTSDYSKYLDEQAAKEFIAWLVKG

SEQ ID NO: 187 - protein, 29 aa, Artificial Sequence
  glucagon analog
  MOD_RES (2)..(2): Xaa is AIB
  MISC_FEATURE (12)..(16): Lactam ring between side chains at positions 12 and 16
  MOD_RES (29)..(29): C-terminal amidation
HXEGTFTSDYSKYLDEQAAKEFIAWLVKG

SEQ ID NO: 188 - protein, 29 aa, Artificial Sequence
  glucagon analog
  MOD_RES (2)..(2): Xaa is AIB
  MISC_FEATURE (16)..(20): Lactam ring between side chains at positions 16 and 20
  MOD_RES (29)..(29): C-terminal amidation
HXEGTFTSDYSKYLDEQAAKEFIAWLVKG

SEQ ID NO: 189 - protein, 29 aa, Artificial Sequence
  glucagon analog
  MOD_RES (2)..(2): Xaa is D-Ala
  MOD_RES (29)..(29): C-terminal amidation
HXEGTFTSDYSKYLDERRAQDFVQWLMNT

SEQ ID NO: 190 - protein, 29 aa, Artificial Sequence
  glucagon analog
  MOD_RES (2)..(2): Xaa is D-Ala
  MOD_RES (29)..(29): C-terminal amidation
HXEGTFTSDYSKYLDERRAKDFVQWLMNT

SEQ ID NO: 191 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): C-terminal amidation
HXEGTFTSDYSKYLDERRAKDFVQWLMNT

SEQ ID NO: 192 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): C-terminal amidation
HXEGTFTSDYSKYLDERRAQDFVQWLMNT

SEQ ID NO: 193 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): C-terminal amidation
HXEGTFTSDYSKYLDERRAKDFVQWLMNT

SEQ ID NO: 194 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): C-terminal amidation
HXEGTFTSDYSKYLDKRRAEDFVQWLMNT

SEQ ID NO: 195 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): C-terminal amidation
HXEGTFTSDYSKYLDERAAKDFVQWLMNT

SEQ ID NO: 196 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): C-terminal amidation
HXEGTFTSDYSKYLDERAAKDFVQWLMNT

SEQ ID NO: 197 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): C-terminal amidation
HXEGTFTSDYSKYLDERAAQDFVQWLMNT

SEQ ID NO: 198 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): C-terminal amidation
HXEGTFTSDYSKYLDERAAKDFVQWLMNT

SEQ ID NO: 199 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): C-terminal amidation
HXEGTFTSDYSKYLDKRAAEDFVQWLMNT

SEQ ID NO: 200 - protein, 29 aa, Artificial Sequence
  glucagon analog
  MOD_RES (2)..(2): Xaa is D-Ala
  MOD_RES (29)..(29): C-terminal amidation
HXEGTFTSDYSKYLDEQAAKEFIAWLMNT

SEQ ID NO: 201 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): C-terminal amidation
HXEGTFTSDYSKYLDEQAAKEFIAWLMNT

SEQ ID NO: 202 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): C-terminal amidation
HXEGTFTSDYSKYLDEQAAKEFIAWLMNT

SEQ ID NO: 203 - protein, 29 aa, Artificial Sequence
  glucagon analog
  MOD_RES (2)..(2): Xaa is D-Ala
  MOD_RES (29)..(29): C-terminal amidation
HXEGTFTSDYSKYLDEQAAKEFIAWLVKG

SEQ ID NO: 204 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): C-terminal amidation
HXEGTFTSDYSKYLDEQAAKEFIAWLVKG

SEQ ID NO: 205 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): Lactam ring between side chains at positions 16 and 20
HXEGTFTSDYSKYLDEQAAKEFIAWLVKG

SEQ ID NO: 206 - protein, 29 aa, Artificial Sequence
  glucagon analog
  MOD_RES (24)..(24): PEGYLATION
  MOD_RES (29)..(29): C-terminal amidation
HSQGTFTSDYSKYLDERRAQDFVCWLMNT

SEQ ID NO: 207 - protein, 29 aa, Artificial Sequence
  glucagon analog
  MOD_RES (24)..(24): PEGYLATION
  MOD_RES (29)..(29): C-terminal amidation
HSQGTFTSDYSKYLDERRAKDFVCWLMNT

SEQ ID NO: 208 - protein, 29 aa, Artificial Sequence
  glucagon analog
  MISC_FEATURE (16)..(20): Lactam ring between side chains at positions 16 and 20
  MOD_RES (24)..(24): PEGYLATION
  MOD_RES (29)..(29): C-terminal amidation
HSQGTFTSDYSKYLDERRAKDFVCWLMNT

SEQ ID NO: 209 - protein, 29 aa, Artificial Sequence
  glucagon analog
  MISC_FEATURE (12)..(16): Lactam ring between side chains at positions 12 and 16
  MOD_RES (24)..(24): PEGYLATION
  MOD_RES (29)..(29): C-terminal amidation
HSQGTFTSDYSKYLDERRAQDFVCWLMNT

SEQ ID NO: 210 - protein, 29 aa, Artificial Sequence
  glucagon analog
  MISC_FEATURE (12)..(16): Lactam ring between side chains at positions 12 and 16
  MOD_RES (24)..(24): PEGYLATION
  MOD_RES (29)..(29): C-terminal amidation
HSQGTFTSDYSKYLDERRAKDFVCWLMNT

SEQ ID NO: 211 - protein, 29 aa, Artificial Sequence
  glucagon analog
  MISC_FEATURE (16)..(20): Lactam ring between side chains at positions 16 and 20
  MOD_RES (24)..(24): PEGYLATION
  MOD_RES (29)..(29): C-terminal amidation
HSQGTFTSDYSKYLDKRRAEDFVCWLMNT

SEQ ID NO: 212 - protein, 29 aa, Artificial Sequence
  glucagon analog
  MISC_FEATURE (16)..(20): Lactam ring between side chains at positions 16 and 20
  MOD_RES (24)..(24): PEGYLATION
  MOD_RES (29)..(29): C-terminal amidation
HSQGTFTSDYSKYLDERAAKDFVCWLMNT

SEQ ID NO: 213 - protein, 29 aa, Artificial Sequence
  glucagon analog
  MISC_FEATURE (16)..(20): Lactam ring between side chains at positions 16 and 20
  MOD_RES (24)..(24): PEGYLATION
  MOD_RES (29)..(29): C-terminal amidation
HSQGTFTSDYSKYLDERAAKDFVCWLMNT

SEQ ID NO: 214 - protein, 29 aa, Artificial Sequence
  glucagon analog
  MISC_FEATURE (12)..(16): Lactam ring between side chains at positions 12 and 16
  MOD_RES (24)..(24): PEGYLATION
  MOD_RES (29)..(29): C-terminal amidation
HSQGTFTSDYSKYLDERAAQDFVCWLMNT

SEQ ID NO: 215 - protein, 29 aa, Artificial Sequence
  glucagon analog
  MISC_FEATURE (12)..(16): Lactam ring between side chains at positions 12 and 16
  MOD_RES (24)..(24): PEGYLATION
  MOD_RES (29)..(29): C-terminal amidation
HSQGTFTSDYSKYLDERAAKDFVCWLMNT

SEQ ID NO: 216 - protein, 29 aa, Artificial Sequence
  glucagon analog
  MISC_FEATURE (16)..(20): Lactam ring between side chains at positions 16 and 20
  MOD_RES (24)..(24): PEGYLATION
  MOD_RES (29)..(29): C-terminal amidation
HSQGTFTSDYSKYLDKRAAEDFVCWLMNT

SEQ ID NO: 217 - protein, 29 aa, Artificial Sequence
  glucagon analog
  MOD_RES (24)..(24): PEGYLATION
  MOD_RES (29)..(29): C-terminal amidation
HSQGTFTSDYSKYLDEQAAKEFICWLMNT

SEQ ID NO: 218 - protein, 29 aa, Artificial Sequence
  glucagon analog
  MISC_FEATURE (12)..(16): Lactam ring between side chains at positions 12 and 16
  MOD_RES (24)..(24): PEGYLATION
  MOD_RES (29)..(29): C-terminal amidation
HSQGTFTSDYSKYLDEQAAKEFICWLMNT

SEQ ID NO: 219 - protein, 29 aa, Artificial Sequence
  glucagon analog
  MISC_FEATURE (16)..(20): Lactam ring between side chains at positions 16 and 20
  MOD_RES (24)..(24): PEGYLATION
  MOD_RES (29)..(29): C-terminal amidation
HSQGTFTSDYSKYLDEQAAKEFICWLMNT

SEQ ID NO: 220 - protein, 29 aa, Artificial Sequence
  glucagon analog
  MOD_RES (24)..(24): PEGYLATION
  MOD_RES (29)..(29): C-terminal amidation
HSQGTFTSDYSKYLDEQAAKEFICWLVKG

SEQ ID NO: 221 - protein, 29 aa, Artificial Sequence
  glucagon analog
  MISC_FEATURE (12)..(16): Lactam ring between side chains at positions 12 and 16
  MOD_RES (24)..(24): PEGYLATION
  MOD_RES (29)..(29): C-terminal amidation
HSQGTFTSDYSKYLDEQAAKEFICWLVKG

SEQ ID NO: 222 - protein, 29 aa, Artificial Sequence
  glucagon analog
  MISC_FEATURE (16)..(20): Lactam ring between side chains at positions 16 and 20
  MOD_RES (24)..(24): PEGYLATION
  MOD_RES (29)..(29): C-terminal amidation
HSQGTFTSDYSKYLDEQAAKEFICWLVKG

SEQ ID NO: 223 - protein, 29 aa, Artificial Sequence
  glucagon analog
  MOD_RES (1)..(1): Xaa is (Des-amino)His
  MOD_RES (24)..(24): PEGYLATION
  MOD_RES (29)..(29): C-terminal amidation
XSQGTFTSDYSKYLDERRAQDFVCWLMNT

SEQ ID NO: 224 - protein, 29 aa, Artificial Sequence
  glucagon analog
  MOD_RES (1)..(1): Xaa is (Des-amino)His
  MOD_RES (24)..(24): PEGYLATION
  MOD_RES (29)..(29): C-terminal amidation
XSQGTFTSDYSKYLDERRAKDFVCWLMNT

SEQ ID NO: 225 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSQGTFTSDYSKYLDERRAKDFVCWLMNT

SEQ ID NO: 226 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSQGTFTSDYSKYLDERRAQDFVCWLMNT

SEQ ID NO: 227 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSQGTFTSDYSKYLDERRAKDFVCWLMNT

SEQ ID NO: 228 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSQGTFTSDYSKYLDKRRAEDFVCWLMNT

SEQ ID NO: 229 - protein, 29 aa, Artificial Sequence
  glucagon analog
  MOD_RES (1)..(1): Xaa is (Des-amino)His
  MOD_RES (24)..(24): PEGYLATION
  MOD_RES (29)..(29): C-terminal amidation
XSQGTFTSDYSKYLDERAAKDFVCWLMNT

SEQ ID NO: 230 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSQGTFTSDYSKYLDERAAKDFVCWLMNT

SEQ ID NO: 231 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSQGTFTSDYSKYLDERAAQDFVCWLMNT

SEQ ID NO: 232 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSQGTFTSDYSKYLDERAAKDFVCWLMNT

SEQ ID NO: 233 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSQGTFTSDYSKYLDKRAAEDFVCWLMNT

SEQ ID NO: 234 - protein, 29 aa, Artificial Sequence
  glucagon analog
  MOD_RES (1)..(1): Xaa is (Des-amino)His
  MOD_RES (24)..(24): PEGYLATION
  MOD_RES (29)..(29): C-terminal amidation
XSQGTFTSDYSKYLDEQAAKEFICWLMNT

SEQ ID NO: 235 - protein, 29 aa, Artificial Sequence
  glucagon analog
  MOD_RES (1)..(1): XAa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSQGTFTSDYSKYLDEQAAKEFICWLMNT

SEQ ID NO: 236 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSQGTFTSDYSKYLDEQAAKEFICWLMNT

SEQ ID NO: 237 - protein, 29 aa, Artificial Sequence
  glucagon analog
  MOD_RES (1)..(1): Xaa is (Des-amino)His
  MOD_RES (24)..(24): PEGYLATION
  MOD_RES (29)..(29): C-terminal amidation
XSQGTFTSDYSKYLDEQAAKEFICWLVKG

SEQ ID NO: 238 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSQGTFTSDYSKYLDEQAAKEFICWLVKG

SEQ ID NO: 239 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSQGTFTSDYSKYLDEQAAKEFICWLVKG

SEQ ID NO: 240 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDERRAQDFVCWLMNT

SEQ ID NO: 241 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDERRAKDFVCWLMNT

SEQ ID NO: 242 - protein, 29 aa, Artificial Sequence
  Synthetic peptide
  MOD_RES (2)..(2): Xaa is AIB
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDERRAKDFVCWLMNT

SEQ ID NO: 243 - protein, 29 aa, Artificial Sequence
  Synthetic peptide
  MOD_RES (2)..(2): Xaa is AIB
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDERRAQDFVCWLMNT

SEQ ID NO: 244 - protein, 29 aa, Artificial Sequence
  Synthetic peptide
  MOD_RES (2)..(2): Xaa is AIB
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDERRAKDFVCWLMNT

SEQ ID NO: 245 - protein, 29 aa, Artificial Sequence
  Synthetic peptide
  MOD_RES (2)..(2): Xaa is AIB
  MISC_FEATURE (16)..(20): Lactam ring side chains at positions 16 and 20
  MOD_RES (24)..(24): PEGYLATION
  MOD_RES (29)..(29): C-terminal amidation
HXQGTFTSDYSKYLDKRRAEDFVCWLMNT

SEQ ID NO: 246 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDERAAKDFVCWLMNT

SEQ ID NO: 247 - protein, 29 aa, Artificial Sequence
  Synthetic peptide
  MOD_RES (2)..(2): Xaa is AIB
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDERAAKDFVCWLMNT

SEQ ID NO: 248 - protein, 29 aa, Artificial Sequence
  Synthetic peptide
  MOD_RES (2)..(2): Xaa is AIB
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDERAAQDFVCWLMNT

SEQ ID NO: 249 - protein, 29 aa, Artificial Sequence
  Synthetic peptide
  MOD_RES (2)..(2): Xaa is AIB
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDERAAKDFVCWLMNT

SEQ ID NO: 250 - protein, 29 aa, Artificial Sequence
  Synthetic peptide
  MOD_RES (2)..(2): Xaa is AIB
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDKRAAEDFVCWLMNT

SEQ ID NO: 251 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDEQAAKEFICWLMNT

SEQ ID NO: 252 - protein, 29 aa, Artificial Sequence
  Synthetic peptide
  misc_feature (2)..(2): Xaa can be any naturally occurring amino acid
HXQGTFTSDYSKYLDEQAAKEFICWLMNT

SEQ ID NO: 253 - protein, 29 aa, Artificial Sequence
  Synthetic peptide
  MOD_RES (2)..(2): Xaa is AIB
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDEQAAKEFICWLMNT

SEQ ID NO: 254 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDEQAAKEFICWLVKG

SEQ ID NO: 255 - protein, 29 aa, Artificial Sequence
  Synthetic peptide
  MOD_RES (2)..(2): Xaa is AIB
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDEQAAKEFICWLVKG

SEQ ID NO: 256 - protein, 29 aa, Artificial Sequence
  Synthetic peptide
  MOD_RES (2)..(2): Xaa is AIB
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDEQAAKEFICWLVKG

SEQ ID NO: 257 - protein, 29 aa, Artificial Sequence
  Synthetic peptide
  MOD_RES (2)..(2): Xaa is D-Ala
  MOD_RES (24)..(24): PEGYLATION
  MOD_RES (29)..(29): C-terminal amidation
HXQGTFTSDYSKYLDERRAQDFVCWLMNT

SEQ ID NO: 258 - protein, 29 aa, Artificial Sequence
  Synthetic peptide
  MOD_RES (2)..(2): Xaa is D-Ala
  MOD_RES (24)..(24): PEGYLATION
  MOD_RES (29)..(29): C-terminal amidation
HXQGTFTSDYSKYLDERRAKDFVCWLMNT

SEQ ID NO: 259 - protein, 29 aa, Artificial Sequence
  Synthetic peptide
  MOD_RES (2)..(2): Xaa is D-Ala
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDERRAKDFVCWLMNT

SEQ ID NO: 260 - protein, 29 aa, Artificial Sequence
  Synthetic peptide
  MOD_RES (2)..(2): Xaa is D-Ala
  MISC_FEATURE (12)..(16): Lactam ring between side chrains at positions 12 and 16
  MOD_RES (24)..(24): PEGYLATION
  MOD_RES (29)..(29): C-terminal amidation
HXQGTFTSDYSKYLDERRAQDFVCWLMNT

SEQ ID NO: 261 - protein, 29 aa, Artificial Sequence
  Synthetic peptide
  MOD_RES (2)..(2): Xaa is D-Ala
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDERRAKDFVCWLMNT

SEQ ID NO: 262 - protein, 29 aa, Artificial Sequence
  Synthetic peptide
  MOD_RES (2)..(2): Xaa is D-Ala
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDKRRAEDFVCWLMNT

SEQ ID NO: 263 - protein, 29 aa, Artificial Sequence
  Synthetic peptide
  MOD_RES (2)..(2): Xaa is D-Ala
  MOD_RES (24)..(24): PEGYLATION
  MOD_RES (29)..(29): C-terminal amidation
HXQGTFTSDYSKYLDERAAKDFVCWLMNT

SEQ ID NO: 264 - protein, 29 aa, Artificial Sequence
  Synthetic peptide
  MOD_RES (2)..(2): Xaa is D-Ala
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDERAAKDFVCWLMNT

SEQ ID NO: 265 - protein, 29 aa, Artificial Sequence
  Synthetic peptide
  MOD_RES (2)..(2): Xaa is D-Ala
  MISC_FEATURE (12)..(16): Lactam ring between side chains at positions 12 and 16
  MOD_RES (24)..(24): PEGYLATION
  MOD_RES (29)..(29): C-terminal amidation
HXQGTFTSDYSKYLDERAAQDFVCWLMNT

SEQ ID NO: 266 - protein, 29 aa, Artificial Sequence
  Synthetic peptide
  MOD_RES (2)..(2): Xaa is D-Ala
  MISC_FEATURE (12)..(16): Lactam ring betwee side chains at positions 12 and 16
  MOD_RES (24)..(24): PEGYLATION
  MOD_RES (29)..(29): C-terminal amidation
HXQGTFTSDYSKYLDERAAKDFVCWLMNT

SEQ ID NO: 267 - protein, 29 aa, Artificial Sequence
  Synthetic peptide
  MOD_RES (2)..(2): Xaa is D-Ala
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDKRAAEDFVCWLMNT

SEQ ID NO: 268 - protein, 29 aa, Artificial Sequence
  Synthetic peptide
  MOD_RES (2)..(2): Xaa is D-Ala
  MOD_RES (24)..(24): PEGYLATION
  MOD_RES (29)..(29): C-terminal amidation
HXQGTFTSDYSKYLDEQAAKEFICWLMNT

SEQ ID NO: 269 - protein, 29 aa, Artificial Sequence
  Synthetic peptide
  MOD_RES (2)..(2): Xaa is D-Ala
  MISC_FEATURE (12)..(16): Lactam ring betwee side chains at positions 12 and 16
  MOD_RES (24)..(24): PEGYLATION
  MOD_RES (29)..(29): C-terminal amidation
HXQGTFTSDYSKYLDEQAAKEFICWLMNT

SEQ ID NO: 270 - protein, 29 aa, Artificial Sequence
  Synthetic peptide
  MOD_RES (2)..(2): Xaa is D-Ala
  MISC_FEATURE (16)..(20): Lactam ring betwee side chains at positions 16 and 20
  MOD_RES (24)..(24): PEGYLATION
  MOD_RES (29)..(29): C-terminal amidation
HXQGTFTSDYSKYLDEQAAKEFICWLMNT

SEQ ID NO: 271 - protein, 29 aa, Artificial Sequence
  Synthetic peptide
  MOD_RES (2)..(2): Xaa is D-Ala
  MOD_RES (24)..(24): PEGYLATION
  MOD_RES (29)..(29): C-terminal amidation
HXQGTFTSDYSKYLDEQAAKEFICWLVKG

SEQ ID NO: 272 - protein, 29 aa, Artificial Sequence
  Synthetic peptide
  MOD_RES (2)..(2): Xaa is D-Ala
  MISC_FEATURE (12)..(16): Lactam ring between side chains at positions 12 and 16
  MOD_RES (24)..(24): PEGYLATION
  MOD_RES (29)..(29): C-terminal midation
HXQGTFTSDYSKYLDEQAAKEFICWLVKG

SEQ ID NO: 273 - protein, 29 aa, Artificial Sequence
  Synthetic peptide
  MOD_RES (2)..(2): Xaa is D-Ala
  MISC_FEATURE (16)..(20): Lactam ring between side chains at positions 16 and 20
  MOD_RES (24)..(24): PEGYLATION
  MOD_RES (29)..(29): C-terminal amidation
HXQGTFTSDYSKYLDEQAAKEFICWLVKG

SEQ ID NO: 274 - protein, 29 aa, Artificial Sequence
  Synthetic peptide
  MOD_RES (24)..(24): PEGYLATION
  MOD_RES (29)..(29): C-terminal amidation
HSEGTFTSDYSKYLDERRAQDFVCWLMNT

SEQ ID NO: 275 - protein, 29 aa, Artificial Sequence
  Synthetic peptide
  MOD_RES (24)..(24): PEGYLATION
  MOD_RES (29)..(29): C-terminal amidation
HSEGTFTSDYSKYLDERRAKDFVCWLMNT

SEQ ID NO: 276 - protein, 29 aa, Artificial Sequence
  Synthetic peptide
  MISC_FEATURE (16)..(20): Lactam ring between side chains at positions 16 and 20
  MOD_RES (24)..(24): PEGYLATION
  MOD_RES (29)..(29): C-terminal amidation
HSEGTFTSDYSKYLDERRAKDFVCWLMNT

SEQ ID NO: 277 - protein, 29 aa, Artificial Sequence
  Synthetic peptide
  MISC_FEATURE (12)..(16): Lactam ring between side chains at positions 12 and 16
  MOD_RES (24)..(24): PEGYLATION
  MOD_RES (29)..(29): C-terminal amidation
HSEGTFTSDYSKYLDERRAQDFVCWLMNT

SEQ ID NO: 278 - protein, 29 aa, Artificial Sequence
  Synthetic peptide
  MISC_FEATURE (12)..(16): Lactam ring between side chains at positions 12 and 16
  MOD_RES (24)..(24): PEGYLATION
  MOD_RES (29)..(29): C-terminal amidation
HSEGTFTSDYSKYLDERRAKDFVCWLMNT

SEQ ID NO: 279 - protein, 29 aa, Artificial Sequence
  Synthetic peptide
  MISC_FEATURE (16)..(20): Lactam ring between side chains at positions 16 and 20
  MOD_RES (24)..(24): PEGYLATION
  MOD_RES (29)..(29): C-terminal amidation
HSEGTFTSDYSKYLDKRRAEDFVCWLMNT

SEQ ID NO: 280 - protein, 29 aa, Artificial Sequence
  Synthetic peptide
  MOD_RES (24)..(24): PEGYLATION
  MOD_RES (29)..(29): C-terminal amidation
HSEGTFTSDYSKYLDERAAKDFVCWLMNT

SEQ ID NO: 281 - protein, 29 aa, Artificial Sequence
  Synthetic peptide
  MISC_FEATURE (16)..(20): Lactam ring between side chains at positions 16 and 20
  MOD_RES (24)..(24): PEGYLATION
  MOD_RES (29)..(29): C-terminal amidation
HSEGTFTSDYSKYLDERAAKDFVCWLMNT

SEQ ID NO: 282 - protein, 29 aa, Artificial Sequence
  Synthetic peptide
  MISC_FEATURE (12)..(16): Lactam ring between side chains at positions 12 and 16
  MOD_RES (24)..(24): PEGYLATION
  MOD_RES (29)..(29): C-terminal amidation
HSEGTFTSDYSKYLDERAAQDFVCWLMNT

SEQ ID NO: 283 - protein, 29 aa, Artificial Sequence
  Synthetic peptide
  MISC_FEATURE (12)..(16): Lactam ring between side chains at positions 12 and 16
  MOD_RES (24)..(24): PEGYLATION
  MOD_RES (29)..(29): C-terminal amidation
HSEGTFTSDYSKYLDERAAKDFVCWLMNT

SEQ ID NO: 284 - protein, 29 aa, Artificial Sequence
  Synthetic peptide
  MISC_FEATURE (16)..(20): Lactam ring between side chains at positions 16 and 20
  MOD_RES (24)..(24): PEGYLATION
  MOD_RES (29)..(29): C-terminal amidation
HSEGTFTSDYSKYLDKRAAEDFVCWLMNT

SEQ ID NO: 285 - protein, 29 aa, Artificial Sequence
  Synthetic peptide
  MOD_RES (24)..(24): PEGYLATION
  MOD_RES (29)..(29): C-terminal amidation
HSEGTFTSDYSKYLDEQAAKEFICWLMNT

SEQ ID NO: 286 - protein, 29 aa, Artificial Sequence
  Synthetic peptide
  MISC_FEATURE (12)..(16): Lactam ring between side chains at positions 12 and 16
  MOD_RES (24)..(24): PEGYLATION
  MOD_RES (29)..(29): C-terminal amidation
HSEGTFTSDYSKYLDEQAAKEFICWLMNT

SEQ ID NO: 287 - protein, 29 aa, Artificial Sequence
  Synthetic peptide
  MISC_FEATURE (16)..(20): Lactam ring between side chain at positions 16 and 20
  MOD_RES (24)..(24): PEGYLATION
  MOD_RES (29)..(29): C-terminal amidation
HSEGTFTSDYSKYLDEQAAKEFICWLMNT

SEQ ID NO: 288 - protein, 29 aa, Artificial Sequence
  Synthetic peptide
  MOD_RES (24)..(24): PEGYLATION
  MOD_RES (29)..(29): C-terminal amidation
HSEGTFTSDYSKYLDEQAAKEFICWLVKG

SEQ ID NO: 289 - protein, 29 aa, Artificial Sequence
  Synthetic peptide
  MISC_FEATURE (12)..(16): Lactam ring between side chains at positions 12 and 16
  MOD_RES (24)..(24): PEGYLATION
  MOD_RES (29)..(29): C-terminal amidation
HSEGTFTSDYSKYLDEQAAKEFICWLVKG

SEQ ID NO: 290 - protein, 29 aa, Artificial Sequence
  Synthetic peptide
  MISC_FEATURE (16)..(20): Lactam ring between side chains at positions 16 and 20
  MOD_RES (24)..(24): PEGYLATION
  MOD_RES (29)..(29): C-terminal amidation
HSEGTFTSDYSKYLDEQAAKEFICWLVKG

SEQ ID NO: 291 - protein, 29 aa, Artificial Sequence
  Synthetic peptide
  MOD_RES (1)..(1): Xaa is (Des-amino)His
  MOD_RES (24)..(24): PEGYLATION
  MOD_RES (29)..(29): C-terminal amidation
XSEGTFTSDYSKYLDERRAQDFVCWLMNT

SEQ ID NO: 292 - protein, 29 aa, Artificial Sequence
  Synthetic peptide
  MOD_RES (1)..(1): Xaa is (Des-amino)His
  MOD_RES (24)..(24): PEGYLATION
  MOD_RES (29)..(29): C-terminal amidation
XSEGTFTSDYSKYLDERRAKDFVCWLMNT

SEQ ID NO: 293 - protein, 29 aa, Artificial Sequence
  Synthetic peptide
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSEGTFTSDYSKYLDERRAKDFVCWLMNT

SEQ ID NO: 294 - protein, 29 aa, Artificial Sequence
  Synthetic peptide
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSEGTFTSDYSKYLDERRAQDFVCWLMNT

SEQ ID NO: 295 - protein, 29 aa, Artificial Sequence
  Synthetic peptide
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSEGTFTSDYSKYLDERRAKDFVCWLMNT

SEQ ID NO: 296 - protein, 29 aa, Artificial Sequence
  Synthetic peptide
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSEGTFTSDYSKYLDKRRAEDFVCWLMNT

SEQ ID NO: 297 - protein, 29 aa, Artificial Sequence
  Synthetic peptide
  MOD_RES (1)..(1): Xaa is (Des-amino)His
  MOD_RES (24)..(24): PEGYLATION
  MOD_RES (29)..(29): C-terminal amidation
XSEGTFTSDYSKYLDERAAKDFVCWLMNT

SEQ ID NO: 298 - protein, 29 aa, Artificial Sequence
  Synthetic peptide
  MOD_RES (1)..(1): Xaa is (Des-amino)His
  MISC_FEATURE (16)..(20): Lactam ring between side chains at positions 16 and 20
  MOD_RES (24)..(24): PEGYLATION
  MOD_RES (29)..(29): C-terminal amidation
XSEGTFTSDYSKYLDERAAKDFVCWLMNT

SEQ ID NO: 299 - protein, 29 aa, Artificial Sequence
  Synthetic peptide
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSEGTFTSDYSKYLDERAAQDFVCWLMNT

SEQ ID NO: 300 - protein, 29 aa, Artificial Sequence
  Synthetic peptide
  MOD_RES (1)..(1): Xaa is (Des-amino)His
  MISC_FEATURE (12)..(16): Lactam ring between side chains at positions 12 and 16
  MOD_RES (24)..(24): PEGYLATION
  MOD_RES (29)..(29): C-terminal amidation
XSEGTFTSDYSKYLDERAAKDFVCWLMNT

SEQ ID NO: 301 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDKRAAEDFVCWLMNT

SEQ ID NO: 302 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDEQAAKGFICWLMNT

SEQ ID NO: 303 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLMNT

SEQ ID NO: 304 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLMNT

SEQ ID NO: 305 - protein, 29 aa, Artificial Sequence
  Synthetic peptide
  MISC_FEATURE: c-term amidation
  MOD_RES (1)..(1): (des-amino)His
  MOD_RES (24)..(24): Cys-PEG
XSEGTFTSDYSKYLDEQAAKGFICWLVKG

SEQ ID NO: 306 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLVKG

SEQ ID NO: 307 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLVKG

SEQ ID NO: 308 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAQDFVCWLMNT

SEQ ID NO: 309 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAKDFVCWLMNT

SEQ ID NO: 310 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 311 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chain at positions 12 and 16
  MOD_RES (24)..(24): Cys-PEG
HXEGTFTSDYSKYLDERRAQDFVCWLMNT

SEQ ID NO: 312 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 313 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 314 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERAAKDFVCWLMNT

SEQ ID NO: 315 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between seide chains at positions 16 and 20
  MOD_RES (24)..(24): Cys-PEG
HXEGTFTSDYSKYLDERAAKDFVCWLMNT

SEQ ID NO: 316 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 317 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERAAKDFVCWLMNT

SEQ ID NO: 318 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRAAEDFVCWLMNT

SEQ ID NO: 319 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLMNT

SEQ ID NO: 320 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 321 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLMNT

SEQ ID NO: 322 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLVKG

SEQ ID NO: 323 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 324 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLVKG

SEQ ID NO: 325 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAQDFVCWLMNT

SEQ ID NO: 326 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAKDFVCWLMNT

SEQ ID NO: 327 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 328 - protein, 29 aa, Artificial Sequence
  Synthetic peptide
  MISC_FEATURE: c-term amidation
  MOD_RES (2)..(2): D-Ala
  MISC_FEATURE (12)..(16): Lactam between side chains at positions 12 and 16
  MOD_RES (24)..(24): Cys-PEG
HXEGTFTSDYSKYLDERRAQDFVCWLMNT

SEQ ID NO: 329 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 330 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 331 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERAAKDFVCWLMNT

SEQ ID NO: 332 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERAAKDFVCWLMNT

SEQ ID NO: 333 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 334 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAKDFVCWLMNT

SEQ ID NO: 335 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chainst at positions 16 and 20
  MOD_RES (24)..(24): Cys-PEG
HXEGTFTSDYSKYLDKRAAEDFVCWLMNT

SEQ ID NO: 336 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLMNT

SEQ ID NO: 337 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 338 - protein, 29 aa, Artificial Sequence
  Synthetic peptide
  MISC_FEATURE: c-term amidation
  MOD_RES (2)..(2): D-Ala
  MISC_FEATURE (16)..(20): Lactam right between side chains at positions 16 and 20
  MOD_RES (24)..(24): Cys-PEG
HXEGTFTSDYSKYLDEQAAKEFICWLMNT

SEQ ID NO: 339 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLVKG

SEQ ID NO: 340 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 341 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDEQAAKEFICWLVKG

SEQ ID NO: 342 - protein, 29 aa, Artificial Sequence
  Synthetic peptide
  MISC_FEATURE: c-term amidation
  MOD_RES (16)..(16): Cys-PEG
HSQGTFTSDYSKYLDCRRAKDFVQWLMNT

SEQ ID NO: 343 - protein, 29 aa, Artificial Sequence
  Synthetic peptide
  MISC_FEATURE: c-term amidation
  MOD_RES (16)..(16): Cys-PEG
HSQGTFTSDYSKYLDCRAAKDFVQWLMNT

SEQ ID NO: 344 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLMNT

SEQ ID NO: 345 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLVKG

SEQ ID NO: 346 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRRAKDFVQWLMNT

SEQ ID NO: 347 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRAAKDFVQWLMNT

SEQ ID NO: 348 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 349 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLVKG

SEQ ID NO: 350 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 351 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCRAAKDFVQWLMNT

SEQ ID NO: 352 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLMNT

SEQ ID NO: 353 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLVKG

SEQ ID NO: 354 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRRAKDFVQWLMNT

SEQ ID NO: 355 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRAAKDFVQWLMNT

SEQ ID NO: 356 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLMNT

SEQ ID NO: 357 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLVKG

SEQ ID NO: 358 - protein, 29 aa, Artificial Sequence
  Synthetic peptide
  MISC_FEATURE: c-term amidation
  MOD_RES (16)..(16): Cys-PEG
HSEGTFTSDYSKYLDCRRAKDFVQWLMNT

SEQ ID NO: 359 - protein, 29 aa, Artificial Sequence
  Synthetic peptide
  MISC_FEATURE: c-term amidation
  MOD_RES (16)..(16): Cys-PEG
HSEGTFTSDYSKYLDCRAAKDFVQWLMNT

SEQ ID NO: 360 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLMNT

SEQ ID NO: 361 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLVKG

SEQ ID NO: 362 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRRAKDFVQWLMNT

SEQ ID NO: 363 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRAAKDFVQWLMNT

SEQ ID NO: 364 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLMNT

SEQ ID NO: 365 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLVKG

SEQ ID NO: 366 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 367 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 368 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 369 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 370 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 371 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 372 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 373 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 374 - protein, 29 aa, Artificial Sequence
  Synthetic peptide
  MISC_FEATURE: c-term amidation
HSQGTFTSDYSKYLDERRAQDFVQWLMDT

SEQ ID NO: 375 - protein, 29 aa, Artificial Sequence
  Synthetic peptide
  MISC_FEATURE: c-term amidation
HSQGTFTSDYSKYLDERRAKDFVQWLMDT

SEQ ID NO: 376 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDERRAKDFVQWLMDT

SEQ ID NO: 377 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAQDFVQWLMDT

SEQ ID NO: 378 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAKDFVQWLMDT

SEQ ID NO: 379 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRRAEDFVQWLMDT

SEQ ID NO: 380 - protein, 29 aa, Artificial Sequence
  Synthetic peptide
  MISC_FEATURE: c-term amidation
HSQGTFTSDYSKYLDERAAKDFVQWLMDT

SEQ ID NO: 381 - protein, 29 aa, Artificial Sequence
  Synthetic peptide
  MISC_FEATURE: c-term amidation; lactam ring between side chains at positions 16 and 20
HSQGTFTSDYSKYLDERAAKDFVQWLMDT

SEQ ID NO: 382 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAQDFVQWLMDT

SEQ ID NO: 383 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAKDFVQWLMDT

SEQ ID NO: 384 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRAAEDFVQWLMDT

SEQ ID NO: 385 - protein, 29 aa, Artificial Sequence
  Synthetic peptide
  MISC_FEATURE: c-term amidation
HSQGTFTSDYSKYLDEQAAKEFIAWLMDT

SEQ ID NO: 386 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDEQAAKEFIAWLMDT

SEQ ID NO: 387 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDEQAAKEFIAWLMDT

SEQ ID NO: 388 - protein, 29 aa, Artificial Sequence
  Synthetic peptide
  MISC_FEATURE: c-term amidation
  MOD_RES (1)..(1): (Des-amino)His
XSQGTFTSDYSKYLDERRAQDFVQWLMDT

SEQ ID NO: 389 - protein, 29 aa, Artificial Sequence
  Synthetic peptide
  MISC_FEATURE: c-term amidation
  MOD_RES (1)..(1): (Des-amino)His
XSQGTFTSDYSKYLDERRAKDFVQWLMDT

SEQ ID NO: 390 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERRAKDFVQWLMDT

SEQ ID NO: 391 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMDT

SEQ ID NO: 392 - protein, 29 aa, Artificial Sequence
  Synthetic peptide
  misc_feature (1)..(1): Xaa can be any naturally occurring amino acid
XSQGTFTSDYSKYLDERRAKDFVQWLMDT

SEQ ID NO: 393 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMDT

SEQ ID NO: 394 - protein, 29 aa, Artificial Sequence
  Synthetic peptide
  MISC_FEATURE: c-term amidation
  MOD_RES (1)..(1): (Des-amino)His
XSQGTFTSDYSKYLDERAAKDFVQWLMDT

SEQ ID NO: 395 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMDT

SEQ ID NO: 396 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMDT

SEQ ID NO: 397 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMDT

SEQ ID NO: 398 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMDT

SEQ ID NO: 399 - protein, 29 aa, Artificial Sequence
  Synthetic peptide
  MISC_FEATURE: c-term amidation
  MOD_RES (1)..(1): (Des-amino)His
XSQGTFTSDYSKYLDEQAAKEFIAWLMDT

SEQ ID NO: 400 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMDT

SEQ ID NO: 401 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMDT

SEQ ID NO: 402 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAQDFVQWLMDT

SEQ ID NO: 403 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAKDFVQWLMDT

SEQ ID NO: 404 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMDT

SEQ ID NO: 405 - protein, 29 aa, Artificial Sequence
  Synthetic peptide
  MISC_FEATURE: c-term amidation
  MOD_RES (2)..(2): aminoisobutyric acid
  MISC_FEATURE (12)..(16): Lactam ring between side chains at positions 12 and 16
HXQGTFTSDYSKYLDERRAQDFVQWLMDT

SEQ ID NO: 406 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERRAKDFVQWLMDT

SEQ ID NO: 407 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDKRRAEDFVQWLMDT

SEQ ID NO: 408 - protein, 29 aa, Artificial Sequence
  Synthetic peptide
  MOD_RES (2)..(2): Aminoisobutyric acid
  MISC_FEATURE (2)..(2): c-term amidation
HXQGTFTSDYSKYLDERAAKDFVQWLMDT

SEQ ID NO: 409 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERAAKDFVQWLMDT

SEQ ID NO: 410 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAQDFVQWLMDT

SEQ ID NO: 411 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAKDFVQWLMDT

SEQ ID NO: 412 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXQGTFTSDYSKYLDKRAAEDFVQWLMDT

SEQ ID NO: 413 - protein, 29 aa, Artificial Sequence
  Synthetic peptide
  MISC_FEATURE: c-term amidation
  MOD_RES (2)..(2): Aminoisobutyric acid
HXQGTFTSDYSKYLDEQAAKEFIAWLMDT

SEQ ID NO: 414 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDEQAAKEFIAWLMDT

SEQ ID NO: 415 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDEQAAKEFIAWLMDT

SEQ ID NO: 416 - protein, 29 aa, Artificial Sequence
  Synthetic peptide
  MISC_FEATURE: c-term amidation
  MOD_RES (2)..(2): D-Ala
HXQGTFTSDYSKYLDERRAQDFVQWLMDT

SEQ ID NO: 417 - protein, 29 aa, Artificial Sequence
  Synthetic peptide
  MISC_FEATURE: c-term amidation
  MOD_RES (2)..(2): D-Ala
HXQGTFTSDYSKYLDERRAKDFVQWLMDT

SEQ ID NO: 418 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERRAKDFVQWLMDT

SEQ ID NO: 419 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAQDFVQWLMDT

SEQ ID NO: 420 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAKDFVQWLMDT

SEQ ID NO: 421 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRRAEDFVQWLMDT

SEQ ID NO: 422 - protein, 29 aa, Artificial Sequence
  Synthetic peptide
  MISC_FEATURE: c-term amidation
  MOD_RES (2)..(2): D-Ala
HXQGTFTSDYSKYLDERAAKDFVQWLMDT

SEQ ID NO: 423 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERAAKDFVQWLMDT

SEQ ID NO: 424 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAQDFVQWLMDT

SEQ ID NO: 425 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAKDFVQWLMDT

SEQ ID NO: 426 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRAAEDFVQWLMDT

SEQ ID NO: 427 - protein, 29 aa, Artificial Sequence
  Synthetic peptide
  MISC_FEATURE: c-term amidation
  MOD_RES (2)..(2): D-Ala
HXQGTFTSDYSKYLDEQAAKEFIAWLMDT

SEQ ID NO: 428 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLMDT

SEQ ID NO: 429 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLMDT

SEQ ID NO: 430 - protein, 29 aa, Artificial Sequence
  Synthetic peptide
  MISC_FEATURE: c-term amidation
HSEGTFTSDYSKYLDERRAQDFVQWLMDT

SEQ ID NO: 431 - protein, 29 aa, Artificial Sequence
  Synthetic peptide
  MISC_FEATURE: c-term amidation
HSEGTFTSDYSKYLDERRAKDFVQWLMDT

SEQ ID NO: 432 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDERRAKDFVQWLMDT

SEQ ID NO: 433 - protein, 29 aa, Artificial Sequence
  Synthetic peptide
  MISC_FEATURE: c-term amidation
  MISC_FEATURE (16)..(16): Lactam ring between side chains at positions 12 and 16
HSEGTFTSDYSKYLDERRAQDFVQWLMDT

SEQ ID NO: 434 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERRAKDFVQWLMDT

SEQ ID NO: 435 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRRAEDFVQWLMDT

SEQ ID NO: 436 - protein, 29 aa, Artificial Sequence
  Synthetic peptide
  MISC_FEATURE: c-term amidation
HSEGTFTSDYSKYLDERAAKDFVQWLMDT

SEQ ID NO: 437 - protein, 29 aa, Artificial Sequence
  Synthetic peptide
  MISC_FEATURE: c-term amidation
  MISC_FEATURE: Lactam ring between side chains at positions 16 and 20
HSEGTFTSDYSKYLDERAAKDFVQWLMDT

SEQ ID NO: 438 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAQDFVQWLMDT

SEQ ID NO: 439 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAKDFVQWLMDT

SEQ ID NO: 440 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRAAEDFVQWLMDT

SEQ ID NO: 441 - protein, 29 aa, Artificial Sequence
  Synthetic peptide
  MISC_FEATURE: c-term amidation
HSEGTFTSDYSKYLDEQAAKEFIAWLMDT

SEQ ID NO: 442 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDEQAAKEFIAWLMDT

SEQ ID NO: 443 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDEQAAKEFIAWLMDT

SEQ ID NO: 444 - protein, 29 aa, Artificial Sequence
  Synthetic peptide
  MISC_FEATURE: c-term amidation
  MOD_RES (1)..(1): (Des-amino)His
XSEGTFTSDYSKYLDERRAQDFVQWLMDT

SEQ ID NO: 445 - protein, 29 aa, Artificial Sequence
  Synthetic peptide
  MISC_FEATURE: c-term amidation
  MOD_RES (1)..(1): (Des-amino)His
XSEGTFTSDYSKYLDERRAKDFVQWLMDT

SEQ ID NO: 446 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERRAKDFVQWLMDT

SEQ ID NO: 447 - protein, 29 aa, Artificial Sequence
  Synthetic peptide
  MISC_FEATURE: c-term amidation
  MISC_FEATURE: Lactam ring between side chains at positions 12 and 16
  MOD_RES (1)..(1): (Des-amino)His
XSEGTFTSDYSKYLDERRAQDFVQWLMDT

SEQ ID NO: 448 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAKDFVQWLMDT

SEQ ID NO: 449 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRRAEDFVQWLMDT

SEQ ID NO: 450 - protein, 29 aa, Artificial Sequence
  Synthetic peptide
  MISC_FEATURE: c-term amidation
  MOD_RES (1)..(1): (Des-amino)His
XSEGTFTSDYSKYLDERAAKDFVQWLMDT

SEQ ID NO: 451 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERAAKDFVQWLMDT

SEQ ID NO: 452 - protein, 29 aa, Artificial Sequence
  Synthetic peptide
  MISC_FEATURE: C-term amidation
  MOD_RES (1)..(1): (Des-amino)His
  MISC_FEATURE (12)..(16): Lactam ring between side chains at positions 12 and 16
XSEGTFTSDYSKYLDERAAQDFVQWLMDT

SEQ ID NO: 453 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAKDFVQWLMDT

SEQ ID NO: 454 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRAAEDFVQWLMDT

SEQ ID NO: 455 - protein, 29 aa, Artificial Sequence
  Synthetic peptide
  MISC_FEATURE: c-term amidation
  MOD_RES (1)..(1): (Des-amino)His
XSEGTFTSDYSKYLDEQAAKEFIAWLMDT

SEQ ID NO: 456 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLMDT

SEQ ID NO: 457 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLMDT

SEQ ID NO: 458 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAQDFVQWLMDT

SEQ ID NO: 459 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAKDFVQWLMDT

SEQ ID NO: 460 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERRAKDFVQWLMDT

SEQ ID NO: 461 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAQDFVQWLMDT

SEQ ID NO: 462 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAKDFVQWLMDT

SEQ ID NO: 463 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRRAEDFVQWLMDT

SEQ ID NO: 464 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERAAKDFVQWLMDT

SEQ ID NO: 465 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERAAKDFVQWLMDT

SEQ ID NO: 466 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at postions 12 and 16
HXEGTFTSDYSKYLDERAAQDFVQWLMDT

SEQ ID NO: 467 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAKDFVQWLMDT

SEQ ID NO: 468 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXEGTFTSDYSKYLDKRAAEDFVQWLMDT

SEQ ID NO: 469 - protein, 29 aa, Artificial Sequence
  Synthetic peptide
  MISC_FEATURE: c-term amidation
  MOD_RES (2)..(2): Aminoisobutyric acid
HXEGTFTSDYSKYLDEQAAKEFIAWLMDT

SEQ ID NO: 470 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLMDT

SEQ ID NO: 471 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLMDT

SEQ ID NO: 472 - protein, 29 aa, Artificial Sequence
  Synthetic peptide
  MISC_FEATURE: c-term amidation
  MOD_RES (2)..(2): D-Ala
HXEGTFTSDYSKYLDERRAQDFVQWLMDT

SEQ ID NO: 473 - protein, 29 aa, Artificial Sequence
  Synthetic peptide
  MISC_FEATURE: c-term amidation
  MOD_RES (2)..(2): D-Ala
HXEGTFTSDYSKYLDERRAKDFVQWLMDT

SEQ ID NO: 474 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERRAKDFVQWLMDT

SEQ ID NO: 475 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAQDFVQWLMDT

SEQ ID NO: 476 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAKDFVQWLMDT

SEQ ID NO: 477 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRRAEDFVQWLMDT

SEQ ID NO: 478 - protein, 29 aa, Artificial Sequence
  Synthetic peptide
  MISC_FEATURE: c-term amidation
  MOD_RES (2)..(2): D-Ala
HXEGTFTSDYSKYLDERAAKDFVQWLMDT

SEQ ID NO: 479 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMDT

SEQ ID NO: 480 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAQDFVQWLMDT

SEQ ID NO: 481 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAKDFVQWLMDT

SEQ ID NO: 482 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRAAEDFVQWLMDT

SEQ ID NO: 483 - protein, 29 aa, Artificial Sequence
  Synthetic peptide
  MISC_FEATURE: c-term amidation
  MOD_RES (2)..(2): D-Ala
HXEGTFTSDYSKYLDEQAAKEFIAWLMDT

SEQ ID NO: 484 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLMDT

SEQ ID NO: 485 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDEQAAKEFIAWLMDT

SEQ ID NO: 486 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 487 - protein, 29 aa, Artificial Sequence
  Synthetic peptide
  MISC_FEATURE: c-term amidation
  MOD_RES (2)..(2): Aminoisobutyric acid
  MOD_RES (29)..(29): Cys-PEG
HXQGTFTSDYSKYLDEQAAKEFIAWLMNC

SEQ ID NO: 488 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDEQAAKEFIAWLMNGGPSSGAPPPSC

SEQ ID NO: 489 - protein, 40 aa, Artificial Sequence; identical to SEQ ID NO: 488
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 490 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNGGPSSGAPPPS

SEQ ID NO: 491 - protein, 39 aa, Artificial Sequence; identical to SEQ ID NO: 490
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 492 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 493 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNC

SEQ ID NO: 494 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNGGPSSGAPPPSC

SEQ ID NO: 495 - protein, 40 aa, Artificial Sequence; identical to SEQ ID NO: 494
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 496 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNGGPSSGAPPPS

SEQ ID NO: 497 - protein, 39 aa, Artificial Sequence; identical to SEQ ID NO: 496
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 498 - protein, 30 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNTA

SEQ ID NO: 499 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVQWLMNC

SEQ ID NO: 500 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDERRAKDFVQWLMNGGPSSGAPPPSC

SEQ ID NO: 501 - protein, 40 aa, Artificial Sequence; identical to SEQ ID NO: 500
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 502 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNGGPSSGAPPPS

SEQ ID NO: 503 - protein, 39 aa, Artificial Sequence; identical to SEQ ID NO: 502
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 504 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLMNT

SEQ ID NO: 505 - protein, 29 aa, Artificial Sequence
  Synthetic peptide
  MISC_FEATURE: c-term amidation
  MOD_RES (1)..(1): Alpha, Alpha-Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNT

SEQ ID NO: 506 - protein, 29 aa, Artificial Sequence
  Synthetic peptide
  MISC_FEATURE: c-term amidation
  MOD_RES (1)..(1): Alpha, Alpha-Dimethly Imidiazole Acetic Acid
  MISC_FEATURE (16)..(20): Lactam ring between side chains at positions 16 and 20
  MOD_RES (29)..(29): Cys-PEG
XSQGTFTSDYSKYLDEQAAKEFIAWLMNC

SEQ ID NO: 507 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDEQAAKEFIAWLMNGGPSSGAPPPSC

SEQ ID NO: 508 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDERRAKDFVQWLMNGGPSSGAPPPSC

SEQ ID NO: 509 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNGGPSSGAPPPS

SEQ ID NO: 510 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  misc_feature (2)..(2): Xaa can be any naturally occurring amino acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 511 - protein, 29 aa, Artificial Sequence
  Synthetic peptide
  MISC_FEATURE: c-term amidation
  MOD_RES (2)..(2): Alpha, Alpha Dimethyl Imidiazole Acetic Acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 512 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (29)..(29): Cys-PEG
XSQGTFTSDYSKYLDERRAKDFVQWLMNC

SEQ ID NO: 513 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDERRAKDFVCWLMNGGPSSGAPPPS

SEQ ID NO: 514 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLMNT

SEQ ID NO: 515 - protein, 11 aa, Artificial Sequence
  Synthetic peptide
GGPSSGAPPPS

SEQ ID NO: 516 - protein, 12 aa, Artificial Sequence
  Synthetic peptide
  MOD_RES (12)..(12): Cys-PEG
GGPSSGAPPPSC

SEQ ID NO: 517 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 518 - protein, 29 aa, Artificial Sequence
  Synthetic peptide
  MISC_FEATURE: c-term amidation
  MOD_RES (24)..(24): Cys-PEG
HSQGTFTSDYSKYLDEQAAKEFICWLMNT

SEQ ID NO: 519 - protein, 29 aa, Artificial Sequence
  Synthetic peptide
  MISC_FEATURE: c-term amidation
  MOD_RES (1)..(1): Alpha, Alpha Dimethly Imidiazole Acetic Acid
  MOD_RES (24)..(24): Cys-PEG
XSQGTFTSDYSKYLDEQAAKEFICWLMNT

SEQ ID NO: 520 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (29)..(29): Cys-PEG
XSQGTFTSDYSKYLDEQAAKEFIAWLMNC

SEQ ID NO: 521 - protein, 39 aa, Artificial Sequence; identical to SEQ ID NO: 36
  Synthetic peptide
  MISC_FEATURE: c-term amidation

SEQ ID NO: 522 - protein, 39 aa, Artificial Sequence
  Synthetic peptide
  MISC_FEATURE: c-term amidation
HSQGTFTSDYSKYLDSRRAQDFVQWLMNGGPSSGAPPPS

SEQ ID NO: 523 - protein, 39 aa, Artificial Sequence
  Synthetic peptide
  MISC_FEATURE: c-term amidation
HSQGTFTSDYSKYLDSRRAQDFVQWLMKGGPSSGAPPPS

SEQ ID NO: 524 - protein, 39 aa, Artificial Sequence
  Synthetic peptide
  MISC_FEATURE: c-term amidation
HSQGTFTSDYSKYLDSRRAQDFVQWLVKGGPSSGAPPPS

SEQ ID NO: 525 - protein, 39 aa, Artificial Sequence
  Synthetic peptide
  MISC_FEATURE: c-term amidation
HSQGTFTSDYSKYLDSRRAQDFVQWLMDGGPSSGAPPPS

SEQ ID NO: 526 - protein, 39 aa, Artificial Sequence
  Synthetic peptide
  MISC_FEATURE: c-term amidation
HSQGTFTSDYSKYLDERRAKDFVQWLMDGGPSSGAPPPS

SEQ ID NO: 527 - protein, 30 aa, Artificial Sequence
  Synthetic peptide
  MISC_FEATURE: c-term amidation
HAEGTFTSDVSSYLEGQAAKEFIAWLVKGG

SEQ ID NO: 528 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 529 - protein, 39 aa, Artificial Sequence; identical to SEQ ID NO: 513
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG

SEQ ID NO: 530 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG
XSQGTFTSDYSKYLDERRAKDFVCWLMNT

SEQ ID NO: 531 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
  MOD_RES (40)..(40): Cys-PEG
HXQGTFTSDYSKYLDERRAKEFICWLMNGGPSSGAPPPSC

SEQ ID NO: 532 - protein, 41 aa, Artificial Sequence
  Synthetic peptide
  MISC_FEATURE: c-term amidation
  MOD_RES (2)..(2): Aminoisobutyric acid
  MOD_RES (40)..(40): Cys-PEG
  MOD_RES (41)..(41): Cys-PEG
HXQGTFTSDYSKYLDEQAAKEFIAWLMNGGPSSGAPPPSCC

SEQ ID NO: 533 - protein, 39 aa, Artificial Sequence; identical to SEQ ID NO: 490
  Synthetic peptide
  MOD_RES (2)..(2): Aminoisobutyric acid
  MOD_RES (24)..(24): Cys-PEG
  MISC_FEATURE (24)..(24): c-term amidation

SEQ ID NO: 534 - protein, 29 aa, Artificial Sequence
  Synthetic peptide
  MISC_FEATURE: Chimera 2 AIB2 K10-C8 Cys 24-40K
  MISC_FEATURE: c-term amidation
  MOD_RES (2)..(2): Aminoisobutyric acid
  MOD_RES (10)..(10): Acylated with C8 fatty acid
  MOD_RES (24)..(24): Cys-PEG
HXQGTFTSDKSKYLDEQAAKEFICWLMNT

SEQ ID NO: 535 - protein, 29 aa, Artificial Sequence
  Synthetic peptide
  MISC_FEATURE: Chimera 2 AIB2 K10-C14 Cys 24-40K
  MISC_FEATURE: c-term amidation
  MOD_RES (2)..(2): Aminoisobutyric acid
  MOD_RES (10)..(10): Acylated with C14 fatty acid
  MOD_RES (24)..(24): Cys-PEG
HXQGTFTSDKSKYLDEQAAKEFICWLMNT

SEQ ID NO: 536 - protein, 29 aa, Artificial Sequence
  Synthetic peptide
  MISC_FEATURE: Chimera 2 AIB2 K10-C16 Cys24-40K
  MISC_FEATURE: c-term amidation
  MOD_RES (2)..(2): Aminoisobutyric acid
  MOD_RES (10)..(10): Acylated with C16 fatty acid
  MOD_RES (24)..(24): Cys-PEG
HXQGTFTSDKSKYLDEQAAKEFICWLMNT

SEQ ID NO: 537 - protein, 29 aa, Artificial Sequence
  Synthetic peptide
  MISC_FEATURE: Chimera 2 AIB2 K10-C18 Cys24-40K
  MISC_FEATURE: c-term amidation
  MOD_RES (2)..(2): Aminoisobutyric acid
  MOD_RES (10)..(10): Acylated with C18 fatty acid
  MOD_RES (24)..(24): Cys-PEG
HXQGTFTSDKSKYLDEQAAKEFICWLMNT

SEQ ID NO: 538 - protein, 29 aa, Artificial Sequence
  Synthetic peptide
  MISC_FEATURE: Chimera 2 K10-C18 Cys24-40K
  MISC_FEATURE: c-term amidation
  MOD_RES (10)..(10): Acylated with C18 fatty acid
  MOD_RES (24)..(24): Cys-PEG
HSQGTFTSDKSKYLDEQAAKEFICWLMNT

SEQ ID NO: 539 - protein, 29 aa, Artificial Sequence
  Synthetic peptide
  MISC_FEATURE: Glucagon E16 K20 K10-C18 Cys24-40K
  MOD_RES (10)..(10): Acylated with C18 fatty acid
  MOD_RES (24)..(24): Cys-PEG
HSQGTFTSDKSKYLDERRAKDFVCWLMNT

SEQ ID NO: 540 - protein, 29 aa, Artificial Sequence
  Synthetic peptide
  MISC_FEATURE: Glucagon E16 K20 K10-W-C18
  MISC_FEATURE: c-term amidation
  MOD_RES (10)..(10): Covalently bound to Trp residue comprising a C18 fatty acid
HSQGTFTSDKSKYLDERRAKDFVQWLMNT

SEQ ID NO: 541 - protein, 29 aa, Artificial Sequence
  Synthetic peptide
  MISC_FEATURE: Glucagon E16 K20 K10-W-C16 Cys24-40K
  MOD_RES (10)..(10): Covalently bound to Trp residue comprising a C16 fatty acid
  MOD_RES (24)..(24): Cys-PEG
HSQGTFTSDKSKYLDERRAKDFVCWLMNT

SEQ ID NO: 542 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to C16 fatty acid
HSQGTFTSDKSKYLDERRAKDFVQWLMNT

SEQ ID NO: 543 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to Trp residue comprising a C16 fatty acid
HSQGTFTSDKSKYLDERRAKDFVQWLMNT

SEQ ID NO: 544 - protein, 29 aa, Artificial Sequence
  Synthetic peptide
  MISC_FEATURE: Glucagon E16 K20 K10-C18
  MISC_FEATURE: c-term amidation
  MOD_RES (10)..(10): Covalently bound to C18 fatty acid
HSQGTFTSDKSKYLDERRAKDFVQWLMNT

SEQ ID NO: 545 - protein, 29 aa, Artificial Sequence
  Synthetic peptide
  MISC_FEATURE: Glucagon E16 K20
  MISC_FEATURE: c-term amidation
HSQGTFTSDYSKYLDERRAKDFVQWLMNT

SEQ ID NO: 546 - protein, 29 aa, Artificial Sequence
  Synthetic peptide
  MISC_FEATURE: Glucagon E16 K20 K10-W-C16 Cys 24-40K
  MISC_FEATURE: c-term amidation
  MOD_RES (10)..(10): Covalently bound to Trp residue comprising C16 fatty acid
  MOD_RES (24)..(24): Cys-PEG
HSQGTFTSDKSKYLDERRAKDFVCWLMNT

SEQ ID NO: 547 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to C18 fatty acid
  MOD_RES (24)..(24): Cys-PEG
HSQGTFTSDKSKYLDERRAKDFVCWLMNT

SEQ ID NO: 548 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to Trp residue comprising a C18 fatty acid
  MOD_RES (24)..(24): Cys-PEG
HSQGTFTSDKSKYLDERRAKDFVCWLMNT

SEQ ID NO: 549 - protein, 29 aa, Artificial Sequence
  Synthetic peptide
  MISC_FEATURE: Glucagon E16 K20 K10-C16 amide
  MISC_FEATURE: c-term amidation
  MOD_RES (10)..(10): Covalently bound to Glu residue comprising a C16 fatty acid
  MOD_RES (24)..(24): Cys-PEG
HSQGTFTSDKSKYLDERRAQDFVCWLMNT

SEQ ID NO: 550 - protein, 28 aa, Artificial Sequence
  Synthetic peptide
  MISC_FEATURE: Chimera 2 truncated by one amino acid
HSQGTFTSDYSKYLDEQAAKEFIAWLMN

SEQ ID NO: 551 - protein, 27 aa, Artificial Sequence
  Synthetic peptide
  MISC_FEATURE: Chimera 2 truncated by two amino acids
HSQGTFTSDYSKYLDEQAAKEFIAWLM

SEQ ID NO: 552 - protein, 28 aa, Artificial Sequence
  Synthetic peptide
  MISC_FEATURE: aa 1-28, E16 K20 C-terminal amide
  MISC_FEATURE: c-term amidation
HSQGTFTSDYSKYLDERRAKDFVQWLMN

SEQ ID NO: 553 - protein, 27 aa, Artificial Sequence
  Synthetic peptide
  MISC_FEATURE: aa 1-27 E16 K20 C-terminal amide
  MISC_FEATURE: c-term amidation
HSQGTFTSDYSKYLDERRAKDFVQWKM

SEQ ID NO: 554 - protein, 29 aa, Artificial Sequence
  Synthetic peptide
  MISC_FEATURE: c-term amidation
  MOD_RES (27)..(27): Norleucine
HSEGTFTSDYSKYLDEQAAKEFIAWLXNT

SEQ ID NO: 555 - protein, 39 aa, Artificial Sequence
  Synthetic peptide
  MISC_FEATURE (16)..(20): Lactam bridging side chains at positions 16 and 20
YSQGTFTSDYSKYLDEQAAKEFVNWLMNGGPSSGAPPPS

SEQ ID NO: 556 - protein, 29 aa, Artificial Sequence
  Synthetic peptide
  MISC_FEATURE: Chimera 2 with AIB at 16
  MISC_FEATURE: c-term amidation
  MOD_RES (16)..(16): Aminoisobutyric acid
HSQGTFTSDYSKYLDXQAAKEFIAWLMNT

SEQ ID NO: 557 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDYSKYLDXRRAQDFVQWLMNT

SEQ ID NO: 558 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (24)..(24): Cys-PEG
HXQGTFTSDKSKYLDXRRAQDFVCWLMNT

SEQ ID NO: 559 - protein, 29 aa, Artificial Sequence
  Synthetic peptide
  MISC_FEATURE: c-term amidation
  MOD_RES (2)..(2): Aminoisobutric Acid
  MISC_FEATURE (10)..(10): Covalently bound to Trp residue comprising a C16 fatty acid
  MOD_RES (16)..(16): Aminoisobutric Acid
HXQGTFTSDKSKYLDXRRAQDFVCWLMNT

SEQ ID NO: 560 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
  MOD_RES (24)..(24): Cys-PEG
HXQGTFTSDKSKYLDXRRAXDFVCWLMNT

SEQ ID NO: 561 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
HXQGTFTSDKSKYLDXRRAXDFVCWLMNT

SEQ ID NO: 562 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDKSKYLDXRRAQDFVQWLMNT

SEQ ID NO: 563 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group
  MOD_RES (16)..(16): Aminoisobutyric Acid
HXQGTFTSDKSKYLDXRRAQDFVQWLMNT

SEQ ID NO: 564 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group via Ala-Ala spacer
  MOD_RES (16)..(16): Aminoisobutyric Acid
HXQGTFTSDKSKYLDXRRAQDFVQWLMNT

SEQ ID NO: 565 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 566 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via beta-Ala-beta-Ala spacer
  MOD_RES (16)..(16): Aminoisobutryic Acid
HXQGTFTSDKSKYLDXRRAQDFVQWLMNT

SEQ ID NO: 567 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via 6-aminohexanoic acid spacer
  MOD_RES (16)..(16): Aminoisobutryic Acid
HXQGTFTSDKSKYLDXRRAQDFVQWLMNT

SEQ ID NO: 568 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Leu-Leu spacer
  MOD_RES (16)..(16): Aminoisobutryic Acid
HXQGTFTSDKSKYLDXRRAQDFVQWLMNT

SEQ ID NO: 569 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Pro-Pro spacer
  MOD_RES (16)..(16): Aminoisobutryic Acid
HXQGTFTSDKSKYLDXRRAQDFVQWLMNT

SEQ ID NO: 570 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group
  MOD_RES (16)..(16): Aminoisobutyric Acid
  MOD_RES (24)..(24): Pegylated
HXQGTFTSDKSKYLDXRRAQDFVCWLMNT

SEQ ID NO: 571 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via gamma-Glu-gamma-Glu spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 572 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 573 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 574 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
HXQGTFTSDKSKYLDXRRAQDFVQWLMNT

SEQ ID NO: 575 - protein, 29 aa, Artificial Sequence
  Synthetic peptide
  MISC_FEATURE: c-term amidation
  MOD_RES (2)..(2): Aminoisobutryic acid
  MOD_RES (10)..(10): Acylated with a C16 fatty acyl group via Ala-Ala spacer
  MOD_RES (16)..(16): Aminoisobutryic acid
  MOD_RES (24)..(24): Pegylated
HXQGTFTSDKSKYLDXRRAQDFVCWLMNT

SEQ ID NO: 576 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 577 - protein, 29 aa, Artificial Sequence
  Synthetic peptide
  MISC_FEATURE: c-term amidation
  MOD_RES (10)..(10): Acylated with a C16 fatty acyl group
HSQGTFTSDKSKYLDSRRAQDFVQWLMNT

SEQ ID NO: 578 - protein, 29 aa, Artificial Sequence
  Synthetic peptide
  MISC_FEATURE: c-term amidation
  MOD_RES (10)..(10): Acylated with a C16 fatty acyl group via gamma-Glu-gamma-Glu spacer
HSQGTFTSDKSKYLDSRRAQDFVQWLMNT

SEQ ID NO: 579 - protein, 29 aa, Artificial Sequence
  Synthetic peptide
  MISC_FEATURE: AA-C16 Glucagon Amide
  MISC_FEATURE: c-term amidation
  MOD_RES (10)..(10): Acylated with a C16 fatty acyl group via Ala-Ala spacer
HSQGTFTSDKSKYLDSRRAQDFVQWLMNT

SEQ ID NO: 580 - protein, 29 aa, Artificial Sequence
  Synthetic peptide
  MISC_FEATURE: Chimera 2, AIB2, Lys10, Cys24-PEG
  MISC_FEATURE: c-term amidation
  MOD_RES (2)..(2): Aminoisobutryic Acid
  MOD_RES (24)..(24): Pegylated
HXQGTFTSDKSKYLDEQAAKEFICWLMNT

SEQ ID NO: 581 - protein, 30 aa, Artificial Sequence
  Synthetic peptide
  MISC_FEATURE: Peptide dS2E16K20K30-C14 Gluc Amide
  MISC_FEATURE: c-term amidation
  MOD_RES (2)..(2): Xaa is d-Ser
  MOD_RES (30)..(30): Acylated with a C14 fatty acyl group
HXQGTFTSDYSKYLDERRAKDFVQWLMNTK

SEQ ID NO: 582 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): Xaa is d-Ser
  MOD_RES (10)..(10): Acylated with a C14 fatty acyl group
HXQGTFTSDKSKYLDERRAKDFVQWLMNT

SEQ ID NO: 583 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): Xaa is d-Ser
  MOD_RES (30)..(30): Acylated with a C16 fatty acyl group

SEQ ID NO: 584 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): Xaa is d-Ser
  MOD_RES (10)..(10): Acylated with a C16 fatty acyl group
HXQGTFTSDKSKYLDERRAKDFVQWLMNT

SEQ ID NO: 585 - protein, 29 aa, Artificial Sequence
  Synthetic peptide
  MISC_FEATURE: Peptide Chimera 2-AIB2-K10-acylated
  MISC_FEATURE: c-term amidation
  MOD_RES (2)..(2): Aminoisobutryic Acid
  MOD_RES (10)..(10): Acylated with a C18 fatty acyl group
  MOD_RES (24)..(24): Pegylated
HXQGTFTSDKSKYLDEQAAKEFICWLMNT

SEQ ID NO: 586 - protein, 30 aa, Artificial Sequence
  Synthetic peptide
  MISC_FEATURE: Peptide Chimera 2-AIB2-K30-acylated
  MISC_FEATURE: c-term amidation
  MOD_RES (2)..(2): Aminoisobutryic Acid
  MOD_RES (24)..(24): Pegylated
  MOD_RES (30)..(30): Acylated with a C18 fatty acyl group
HXQGTFTSDYSKYLDEQAAKEFICWLMNTK

SEQ ID NO: 587 - protein, 29 aa, Artificial Sequence
  Synthetic peptide
  MISC_FEATURE: c-term amidation
  MOD_RES (1)..(1): DMIA
XSQGTFTSDYSKYLDERRAKDFVCWLMNT

SEQ ID NO: 588 - protein, 29 aa, Artificial Sequence
  Synthetic peptide
  MISC_FEATURE: c-term amidation
  MOD_RES (1)..(1): DMIA
  MOD_RES (16)..(20): Lactam ring between side chains of amino acids at positions 16 and 20
XSQGTFTSDYSKYLDERRAKDFVCWLMNT

SEQ ID NO: 589 - protein, 29 aa, Artificial Sequence
  Synthetic peptide
  MISC_FEATURE: c-term amidation
  MOD_RES (2)..(2): Aminoisobutryic Acid
HXEGTFTSDYSKYLDEQAAKEFICWLMNT

SEQ ID NO: 590 - protein, 29 aa, Artificial Sequence
  Synthetic peptide
  MISC_FEATURE: c-term amidation
  MOD_RES (2)..(2): Aminoisobutryic Acid
  MOD_RES (24)..(24): Pegylated
HXEGTFTSDYSKYLDEQAAKEFICWLMNT

SEQ ID NO: 591 - protein, 29 aa, Artificial Sequence
  Synthetic peptide
  MOD_RES (3)..(3): Xaa is a Glutamine analog
  MOD_RES (27)..(27): Xaa is Norleucine
HSXGTFTSDYSKYLDTRRAAEFVAWLXDE

SEQ ID NO: 592 - protein, 29 aa, Artificial Sequence
  Synthetic peptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 593 - protein, 29 aa, Artificial Sequence
  Synthetic peptide
  MOD_RES (27)..(27): Xaa is Norleucine
HSQGTFTSDYSKYLDTRRAAEFVAWLXDE

SEQ ID NO: 594 - protein, 29 aa, Artificial Sequence
  Synthetic peptide
  MOD_RES (3)..(3): Xaa is Acetamidomethyl-cysteine
  MOD_RES (27)..(27): Xaa is Norleucine
HSXGTFTSDYSKYLDTRRAAEFVAWLXDE

SEQ ID NO: 595 - protein, 29 aa, Artificial Sequence
  Synthetic peptide
  MOD_RES (3)..(3): Xaa is Acetyldiaminobutanoic acid
  MOD_RES (27)..(27): Xaa is Norleucine
HSXGTFTSDYSKYLDTRRAAEFVAWLXDE

SEQ ID NO: 596 - protein, 29 aa, Artificial Sequence
  Synthetic peptide
  MOD_RES (3)..(3): Xaa is carbamoyldiaminopropanoic acid
  MOD_RES (27)..(27): Xaa is Norleucine
HSXGTFTSDYSKYLDTRRAAEFVAWLXDE

SEQ ID NO: 597 - protein, 29 aa, Artificial Sequence
  Synthetic peptide
  MOD_RES (3)..(3): Xaa is Methylglutamine
  MOD_RES (27)..(27): Xaa is Norleucine
HSXGTFTSDYSKYLDTRRAAEFVAWLXDE

SEQ ID NO: 598 - protein, 29 aa, Artificial Sequence
  Synthetic peptide
  MOD_RES (3)..(3): Xaa is Methionine sulfoxide
  MOD_RES (27)..(27): Xaa is Norleucine
HSXGTFTSDYSKYLDTRRAAEFVAWLXDE

SEQ ID NO: 599 - protein, 29 aa, Artificial Sequence
  Synthetic peptide
  MOD_RES (3)..(3): Acetylornithine
  MOD_RES (27)..(27): Xaa is Norleucine
HSXGTFTSDYSKYLDTRRAAEFVAWLXDE

SEQ ID NO: 600 - protein, 29 aa, Artificial Sequence
  Synthetic peptide
  MOD_RES (16)..(16): Xaa is Aminoisobutryic Acid
HSQGTFTSDYSKYLDXRRAADFVAWLMDE

SEQ ID NO: 601 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLMDE

SEQ ID NO: 602 - protein, 29 aa, Artificial Sequence
  Synthetic peptide
  MOD_RES (3)..(3): Xaa is Methylglutamine
  MOD_RES (16)..(16): Xaa is Aminoisobutyric Acid
HSXGTFTSDYSKYLDXRRAADFVAWLMDE

SEQ ID NO: 603 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRAADFVAWLLDE

SEQ ID NO: 604 - protein, 39 aa, Artificial Sequence
  Synthetic peptide
  MISC_FEATURE: c-term amidation
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLLDTGPSSGAPPPS

SEQ ID NO: 605 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRASDFVSWLLDE

SEQ ID NO: 606 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRATDFVTWLLDE

SEQ ID NO: 607 - protein, 29 aa, Artificial Sequence
  Synthetic peptide
  MISC_FEATURE: c-term amidation
  MOD_RES (1)..(1): Xaa is Dmia
  MOD_RES (10)..(10): Covalently bound to a C14 fatty acyl group
  MOD_RES (16)..(20): Lactam ring between side chains of amino acids at positions 16 and 20
XSQGTFTSDKSKYLDERRAKDFVQWLMNT

SEQ ID NO: 608 - protein, 29 aa, Artificial Sequence
  Synthetic peptide
  MISC_FEATURE: c-term amidation
  MOD_RES (1)..(1): DMIA
  MOD_RES (10)..(10): Covalently bound to C16 fatty acyl group
  MOD_RES (16)..(20): Lactam ring between side chains of amino acids at positions 16 and 20
XSQGTFTSDKSKYLDERRAKDFVQWLMNT

SEQ ID NO: 609 - protein, 29 aa, Artificial Sequence
  Synthetic peptide
  MISC_FEATURE: c-term amidation
  MOD_RES (1)..(1): DMIA
  MOD_RES (10)..(10): Covalently bound to C18 fatty acyl group
  MOD_RES (16)..(20): Lactam ring between side chains of amino acids at positions 16 and 20
XSQGTFTSDKSKYLDERRAKDFVQWLMNT

SEQ ID NO: 610 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group
  MOD_RES (16)..(16): Aminoisobutryic Acid
HXQGTFTSDKSKYLDXRRAQDFVQWLMNT

SEQ ID NO: 611 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C16 fatty acyl group
  MOD_RES (16)..(16): Aminoisobutryic Acid
HXQGTFTSDKSKYLDXRRAQDFVQWLMNT

SEQ ID NO: 612 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C18 fatty acyl group
  MOD_RES (16)..(16): Aminoisobutryic Acid
HXQGTFTSDKSKYLDXRRAQDFVQWLMNT

SEQ ID NO: 613 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C14 fatty acyl group
HXQGTFTSDKSKYLDERRAKDFVQWLMNT

SEQ ID NO: 614 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C16 fatty acyl group
HXQGTFTSDKSKYLDERRAKDFVQWLMNT

SEQ ID NO: 615 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to a C18 fatty acyl group
HXQGTFTSDKSKYLDERRAKDFVQWLMNT

SEQ ID NO: 616 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to a C14 fatty acyl group
  MOD_RES (16)..(16): Aminoisobutyric Acid
HXQGTFTSDKSKYLDXRRAQDFVCWLMNT

SEQ ID NO: 617 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via gamma-Glu-gamma-Glu spacer
  MOD_RES (16)..(16): Aminoisobutryic Acid
HXQGTFTSDKSKYLDXRRAQDFVCWLMNT

SEQ ID NO: 618 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via Ala-Ala spacer
  MOD_RES (16)..(16): Aminoisobutryic Acid
HXQGTFTSDKSKYLDXRRAQDFVCWLMNT

SEQ ID NO: 619 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group via di peptide spacer
  MOD_RES (16)..(16): Aminoisobutyric Acid
HXQGTFTSDKSKYLDXRRAQDFVCWLMNT

SEQ ID NO: 620 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covelently bound to C16 fatty acyl group via Ala-Ala spacer
  MOD_RES (16)..(16): Aminoisobutyric Acid
HXQGTFTSDKSKYLDXRRAQDFVCWLMNT

SEQ ID NO: 621 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNT

SEQ ID NO: 622 - protein, 30 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNTK

SEQ ID NO: 623 - protein, 29 aa, Artificial Sequence
  Synthetic peptide
  MISC_FEATURE: beta-Ala-beta-Ala - C16 Glucagon Amide
  MISC_FEATURE: c-term amidation
  MISC_FEATURE (10)..(10): Acylated with a C16 fatty acyl group via beta-Ala-beta-Ala spacer
HSQGTFTSDKSKYLDSRRAQDFVQWLMNT

SEQ ID NO: 624 - protein, 29 aa, Artificial Sequence
  Synthetic peptide
  MISC_FEATURE: Chimera-2 Aib2C24Mal40KPEG
  MOD_RES (2)..(2): Xaa is Aib
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 625 - protein, 29 aa, Artificial Sequence
  Synthetic peptide
  MISC_FEATURE: Chimera-2 Aib2E16K20lactamC24Mal40KPEG
  MOD_RES (2)..(2): Xaa is Aib
  MISC_FEATURE (16)..(20): Lactam ring between side chains of the amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 626 - protein, 29 aa, Artificial Sequence
  Synthetic peptide
  MISC_FEATURE: Glucagon Aib2E16K20lactamC24amideMal40KPEG
  MOD_RES (2)..(2): Xaa is Aib
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDERRAKDFVCWLMNT

SEQ ID NO: 627 - skipped

SEQ ID NO: 628 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
XSQGTFTSDYSKYLDERRAKDFVCWLMNT

SEQ ID NO: 629 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MISC_FEATURE (24)..(24): Covalently bound to 40kDa PEG via thioether made by reaction of peptide with a maleimide-activated PEG
XSQGTFTSDYSKYLDERRAKDFVCWLMNT

SEQ ID NO: 630 - protein, 29 aa, Artificial Sequence
  Synthetic peptide
  MISC_FEATURE: Glucagon Dmia1E16K20lactamC24thioether40KPEG
  MOD_RES (1)..(1): Xaa is Dmia
  MISC_FEATURE (16)..(20): Lactam ring between side chains of amino acids at position 16 and 20
  MOD_RES (24)..(24): Covalently bound to 40kDa PEG via thioether made by reaction of peptide with haloacetyl-activated PEG
  MOD_RES (29)..(29): AMIDATION
XSQGTFTSDYSKYLDERRAKDFVCWLMNT

SEQ ID NO: 631 - protein, 29 aa, Artificial Sequence
  Synthetic peptide
  MISC_FEATURE: Chimera2 Aib2E3C24-Thioether40K PEG
  MOD_RES (2)..(2): Xaa is Aib
  MOD_RES (24)..(24): Covalently bound to 40kDa PEG via thioether made by reaction of peptide with haloacetyl-activated PEG
  MOD_RES (29)..(29): AMIDATION
HXEGTFTSDYSKYLDEQAAKEFICWLMNT

SEQ ID NO: 632 - protein, 29 aa, Artificial Sequence
  Synthetic peptide
  MOD_RES (1)..(1): Xaa is Dmia
  MOD_RES (24)..(24): Covalently bound to 40kDa PEG
  MOD_RES (29)..(29): AMIDATION
XSEGTFTSDYSKYLEERRAKDFVCWLMNT

SEQ ID NO: 633 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via gamma-Glu-gamma-Glu spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 634 - protein, 29 aa, Artificial Sequence
  Synthetic peptide
  MISC_FEATURE: Glucagon Aib2Aib16K10(AA-C14)C24PEG40K TE amide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 635 - protein, 29 aa, Artificial Sequence
  Synthetic peptide
  MISC_FEATURE: Glucagon Aib2Aib16K10(AA-C16) amide
  MOD_RES (2)..(2): Xaa is Aib
  MOD_RES (10)..(10): Covalently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 636 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via gamma-Glu-gamma-Glu spacer
  MOD_RES (16)..(16): Xaa is Aib
  MOD_RES (29)..(29): AMIDATION
HXQGTFTSDKSKYLDXRRAQDFVQWLMNT

SEQ ID NO: 637 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 638 - DNA, 20 bp, Artificial Sequence
  Synthetic primer
caaggtccagggaggttgtg

SEQ ID NO: 639 - DNA, 24 bp, Artificial Sequence
  Synthetic primer
ccaaaggtaagctgtccataagga

SEQ ID NO: 640 - DNA, 22 bp, Artificial Sequence
  Synthetic primer
ctctcccaagagtcacatgtcc

SEQ ID NO: 641 - DNA, 22 bp, Artificial Sequence
  Synthetic primer
caataactcggtcccctacaac

SEQ ID NO: 642 - protein, 29 aa, Artificial Sequence
  Synthetic peptide
HSQGTFTSDYSKYLDSRRAQDFVQWLMDT

SEQ ID NO: 643 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu spacer
HXQGTFTSDKSKYLDEQAAKEFIAWLMNT

SEQ ID NO: 644 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 645 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFTSDKSKYLDEQAAKEFIAWLMNT

SEQ ID NO: 646 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 647 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group
HXEGTFTSDKSKYLDEQAAKEFIAWLMNT

SEQ ID NO: 648 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXEGTFTSDKSKYLDEQAAKEFIAWLMNT

SEQ ID NO: 649 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFISDKSKYLDEQAAKEFIAWLMNT

SEQ ID NO: 650 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFISDKSKYLDEQAAKEFIAWLMNT

SEQ ID NO: 651 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 652 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu-gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 653 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu spacer
XSQGTFTSDYSKYLDERRAKDFVQWLMNK

SEQ ID NO: 654 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu-gamma-Glu spacer
XSQGTFTSDYSKYLDERRAKDFVQWLMNK

SEQ ID NO: 655 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
  MOD_RES (16)..(16): Xaa is Aib
HXQGTFTSDKSKYLDXRAAQDFVQWLMDT

SEQ ID NO: 656 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
  MOD_RES (16)..(16): Xaa is Aib
HXQGTFTSDKSKYLDXRAAQDFVQWLMDT

SEQ ID NO: 657 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
HXQGTFTSDKSKYLDXRRAQDFVQWLMNT

SEQ ID NO: 658 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via dipeptide spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 659 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via dipeptide spacer
  MOD_RES (16)..(16): Aminoisobutryic Acid
HXQGTFTSDKSKYLDXRRAQDFVQWLMNT

SEQ ID NO: 660 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 661 - protein, 29 aa, Artificial Sequence
  Synthetic peptide
  MISC_FEATURE: c-term amidation
  MOD_RES (10)..(10): Acylated with a C16 fatty acyl group via dipeptide spacer
HSQGTFTSDKSKYLDSRRAQDFVQWLMNT

SEQ ID NO: 662 - protein, 30 aa, Artificial Sequence; identical to SEQ ID NO: 581
  Synthetic peptide
  MISC_FEATURE: Peptide dS2E16K20K30-C14 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group

SEQ ID NO: 663 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
HXQGTFTSDKSKYLDERRAKDFVQWLMNT

SEQ ID NO: 664 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group

SEQ ID NO: 665 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
HXQGTFTSDKSKYLDERRAKDFVQWLMNT

SEQ ID NO: 666 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C14 fatty acyl group
HXQGTFTSDKSKYLDERRAKDFVQWLMNT

SEQ ID NO: 667 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C16 fatty acyl group
HXQGTFTSDKSKYLDERRAKDFVQWLMNT

SEQ ID NO: 668 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to a C18 fatty acyl group
HXQGTFTSDKSKYLDERRAKDFVQWLMNT

SEQ ID NO: 669 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via dipeptide spacer
  MOD_RES (16)..(16): Aminoisobutryic Acid
HXQGTFTSDKSKYLDXRRAQDFVCWLMNT

SEQ ID NO: 670 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 671 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 672 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via acidic amino acid spacer
HXQGTFTSDKSKYLDEQAAKEFIAWLMNT

SEQ ID NO: 673 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via dipeptide spacer
HXQGTFTSDKSKYLDEQAAKEFIAWLMNT

SEQ ID NO: 674 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFTSDKSKYLDEQAAKEFIAWLMNT

SEQ ID NO: 675 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFTSDKSKYLDEQAAKEFIAWLMNT

SEQ ID NO: 676 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXEGTFTSDKSKYLDEQAAKEFIAWLMNT

SEQ ID NO: 677 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFISDKSKYLDEQAAKEFIAWLMNT

SEQ ID NO: 678 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFISDKSKYLDEQAAKEFIAWLMNT

SEQ ID NO: 679 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via acidic amino acid spacer
  MISC_FEATURE (16)..(20): Lactam ring between side chains of amino acids at positions 16 and 20
XSQGTFTSDKSKYLDERRAKDFVQWLMNT

SEQ ID NO: 680 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via dipeptide spacer
  MISC_FEATURE (16)..(20): Lactam ring between side chains of amino acids at positions 16 and 20
XSQGTFTSDKSKYLDERRAKDFVQWLMNT

SEQ ID NO: 681 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via acidic amino acid spacer
XSQGTFTSDYSKYLDERRAKDFVQWLMNK

SEQ ID NO: 682 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via dipeptide spacer
XSQGTFTSDYSKYLDERRAKDFVQWLMNK

SEQ ID NO: 683 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
  MOD_RES (16)..(16): Xaa is Aib
HXQGTFTSDKSKYLDXRAAQDFVQWLMDT

SEQ ID NO: 684 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
  MOD_RES (16)..(16): Xaa is Aib
HXQGTFTSDKSKYLDXRAAQDFVQWLMDT

SEQ ID NO: 685 - protein, 29 aa, Artificial Sequence
  Synthetic peptide
  MOD_RES (2)..(2): Xaa is AIB
  misc_feature (16)..(16): Xaa can be any naturally occurring amino acid
  misc_feature (20)..(20): Xaa can be any naturally occurring amino acid
  MOD_RES (29)..(29): C-terminal amidation
HSQGTFTSDYSKYLDXQAAXGFIAWLMNT

SEQ ID NO: 686 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (16)..(16): Xaa is AIB
  MOD_RES (29)..(29): C-terminal amidation
HXQGTFTSDKSKYLDXRAAQDFVQWLMDT

SEQ ID NO: 687 - protein, 29 aa, Artificial Sequence
  Synthetic peptide
  MOD_RES (2)..(2): Xaa is AIB
  MOD_RES (10)..(10): Acylated with C14 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 688 - protein, 29 aa, Artificial Sequence
  Synthetic peptide
  MOD_RES (2)..(2): Xaa is AIB
  MOD_RES (10)..(10): Acylated with C18 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 689 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXEGTFTSDKSKYLDXRAAQDFVQWLMDT

SEQ ID NO: 690 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
HXQGTFISDKSKYLDXRAAQDFVQWLMDT

SEQ ID NO: 691 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDERAAQDFVQWLMDT

SEQ ID NO: 692 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLEXRAAQDFVQWLMDT

SEQ ID NO: 693 - protein, 29 aa, Artificial Sequence
  Synthetic peptide
  MOD_RES (2)..(2): d-Ser
  MOD_RES (10)..(10): Acylated with C16 fatty acyl group via dipeptide spacer
  MOD_RES (16)..(16): Xaa is AIB
  MOD_RES (29)..(29): C-terminal amidation
HSQGTFTSDKSKYLDXRAAQDFVQWLMDT

SEQ ID NO: 694 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLLDT

SEQ ID NO: 695 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDEQAAKEFIAWLLDT

SEQ ID NO: 696 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEQAAKEFICWLLDT

SEQ ID NO: 697 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDEQAAKEFICWLLDT

SEQ ID NO: 698 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDERAAQDFVCWLLDT

SEQ ID NO: 699 - protein, 30 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (30)..(30): PEGYLATION
  MOD_RES (30)..(30): C-terminal amidation
HXQGTFTSDKSKYLDEQAAKEFIQWLLDTC

SEQ ID NO: 700 - protein, 29 aa, Artificial Sequence
  Synthetic peptide
  MOD_RES (10)..(10): Acylated with C16 fatty acyl group via gamma-Glu spacer
  MOD_RES (24)..(24): PEGYLATION
  MOD_RES (29)..(29): C-terminal amidation
HAQGTFTSDKSKYLDERAAQDFVCWLLDT

SEQ ID NO: 701 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 702 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVQWLLDT

SEQ ID NO: 703 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVCWLLDT

SEQ ID NO: 704 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
HSQGTFTSDKSKYLDEQAAKEFICWLLDT

SEQ ID NO: 705 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (31)..(31): C-terminal amidation
HSQGTFTSDKSKYLDEQAAKEFICWLLDTGE

SEQ ID NO: 706 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTGG

SEQ ID NO: 707 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDERAAQDFVCWLLDT

SEQ ID NO: 708 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (30)..(30): PEGYLATION
  MOD_RES (30)..(30): C-terminal amidation
HSQGTFTSDKSKYLDERAAQDFVQWLLDTC

SEQ ID NO: 709 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (30)..(30): C-terminal amidation
HSQGTFTSDYSKYLDSRRAQDFVQWLMNTE

SEQ ID NO: 710 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTC

SEQ ID NO: 711 - protein, 29 aa, Artificial Sequence
  Synthetic peptide
  MOD_RES (1)..(1): Xaa is DMIA
  MOD_RES (10)..(10): Acylated with C16 fatty acyl group via gamma-Glu spacer
  MOD_RES (29)..(29): C-terminal amidation
XSQGTFTSDKSKYLDEQAAKEFICWLLDT

SEQ ID NO: 712 - protein, 29 aa, Artificial Sequence
  Synthetic peptide
  MOD_RES (1)..(1): des-amino-His
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 713 - protein, 29 aa, Artificial Sequence
  Synthetic peptide
  MOD_RES (1)..(1): Ac-His
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDEQAAKEFICWLLDT

SEQ ID NO: 714 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEEAVRLFIEWLMNT

SEQ ID NO: 715 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (29)..(29): C-terminal amidation
HXQGTFTSDKSKYLDEEAVRLFIEWLMNT

SEQ ID NO: 716 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDEEAVRLFICWLMNT

SEQ ID NO: 717 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFIEWLMNT

SEQ ID NO: 718 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFICWLMNT

SEQ ID NO: 719 - protein, 29 aa, Artificial Sequence
  Synthetic peptide
  MOD_RES (2)..(2): d-Ser
  MOD_RES (24)..(24): PEGYLATION
  MOD_RES (29)..(29): C-terminal amidation
HSQGTFTSDYSKYLDEEAVRLFICWLMNT

SEQ ID NO: 720 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFIEWLMNT

SEQ ID NO: 721 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFICWLMNT

SEQ ID NO: 722 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 723 - protein, 29 aa, Artificial Sequence
  Synthetic peptide
  MOD_RES (10)..(10): Acylated with C16 fatty acyl group via gamma-Glu spacer
  MOD_RES (29)..(29): C-terminal amidation
HSQGTFTSDKSKYLDEEAVRLFIEWLMNT

SEQ ID NO: 724 - protein, 29 aa, Artificial Sequence
  Synthetic peptide
  MOD_RES (2)..(2): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 725 - protein, 29 aa, Artificial Sequence
  Synthetic peptide
  MOD_RES (2)..(2): Xaa is AIB
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDXKRAKEFVCWLMNT

SEQ ID NO: 726 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDEKRAKEFVCWLMNT

SEQ ID NO: 727 - protein, 29 aa, Artificial Sequence
  Synthetic peptide
  MOD_RES (2)..(2): d-Ser
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 728 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 729 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (29)..(29): C-terminal amidation
HSQGTFTSDYSKYLDXKRAKEFVQWLMNT

SEQ ID NO: 730 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via gamma-Glu spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 731 - protein, 29 aa, Artificial Sequence
  Synthetic peptide
  MOD_RES (1)..(1): Xaa is DMIA
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
XSQGTFTSDYSKYLDXKRAKEFVCWLMNT

SEQ ID NO: 732 - protein, 29 aa, Artificial Sequence
  Synthetic peptide
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 733 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 734 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 735 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDEQAAKEFICWLLDT

SEQ ID NO: 736 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 737 - protein, 30 aa, Artificial Sequence; identical to SEQ ID NO: 699
  Synthetic peptide
  MOD_RES (2)..(2): Xaa is AIB
  MOD_RES (10)..(10): Acylated with C16 fatty acyl group via acidic amino acid spacer
  MOD_RES (30)..(30): PEGYLATION
  MOD_RES (30)..(30): C-terminal amidation

SEQ ID NO: 738 - protein, 29 aa, Artificial Sequence
  Synthetic peptide
  MOD_RES (10)..(10): Acylated with C16 fatty acyl group via acidic amino acid spacer
  MOD_RES (24)..(24): PEGYLATION
  MOD_RES (29)..(29): C-terminal amidation
HAQGTFTSDKSKYLDERAAQDFVCWLLDT

SEQ ID NO: 739 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 740 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVQWLLDT

SEQ ID NO: 741 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVCWLLDT

SEQ ID NO: 742 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
HXQGTFTSDKSKYLDEQAAKEFICWLLDT

SEQ ID NO: 743 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (31)..(31): C-terminal amidation
HXQGTFTSDKSKYLDEQAAKEFICWLLDTGE

SEQ ID NO: 744 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTGG

SEQ ID NO: 745 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 746 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (30)..(30): PEGYLATION
  MOD_RES (30)..(30): C-terminal amidation
HXQGTFTSDKSKYLDERAAQDFVQWLLDTC

SEQ ID NO: 747 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (30)..(30): C-terminal amidation
HXQGTFTSDYSKYLDSRRAQDFVQWLMNTE

SEQ ID NO: 748 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTC

SEQ ID NO: 749 - protein, 29 aa, Artificial Sequence
  Synthetic peptide
  MOD_RES (1)..(1): Xaa is DMIA
  MOD_RES (10)..(10): Acylated with C16 fatty acyl group via acidic amino acid spacer
  MOD_RES (29)..(29): C-terminal amidation
XSQGTFTSDKSKYLDEQAAKEFICWLLDT

SEQ ID NO: 750 - protein, 29 aa, Artificial Sequence
  Synthetic peptide
  MOD_RES (1)..(1): des-amino-His
  MOD_RES (10)..(10): Acylated with C16 fatty acyl group via acidic amino acid spacer
  MOD_RES (29)..(29): C-terminal amidation
HSQGTFTSDKSKYLDEQAAKEFICWLLDT

SEQ ID NO: 751 - protein, 29 aa, Artificial Sequence
  Synthetic peptide
  MOD_RES (1)..(1): Ac-His
  MOD_RES (10)..(10): Acylated with C16 fatty acyl group via acidic amino acid spacer
  MOD_RES (24)..(24): PEGYLATION
  MOD_RES (29)..(29): C-terminal amidation
HSQGTFTSDKSKYLDEQAAKEFICWLLDT

SEQ ID NO: 752 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEEAVRLFIEWLMNT

SEQ ID NO: 753 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (24)..(24): PEGYLATION
  MOD_RES (29)..(29): C-terminal amidation
HXQGTFTSDYSKYLDEEAVRLFICWLMNT

SEQ ID NO: 754 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFIEWLMNT

SEQ ID NO: 755 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFICWLMNT

SEQ ID NO: 756 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 757 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 758 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 759 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 760 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 761-800 - skipped (40 entries)

SEQ ID NO: 801 - protein, 29 aa, Homo sapiens
HSQGTFTSDYSKYLDSRRAQDFVQWLMNT

SEQ ID NO: 802 - protein, 29 aa, Artificial Sequence
  Glucagon analogue
  MOD_RES (16)..(16): Xaa is Ser, Cys, Orn, homocysteine or acetyl phenyalanine
  MOD_RES (27)..(27): Xaa is Met, Leu or Nle
HSQGTFTSDYSKYLDXRRAQDFVQWLXDT

SEQ ID NO: 803 - protein, 29 aa, Artificial Sequence
  Glucagon analogue
  MOD_RES (17)..(17): Xaa is Arg, Cys, Orn, homocysteine or acetyl phenyalanine
  MOD_RES (27)..(27): Xaa is Met, Leu or Nle
HSQGTFTSDYSKYLDSXRAQDFVQWLXDT

SEQ ID NO: 804 - protein, 29 aa, Artificial Sequence
  Glucagon analogue
  MOD_RES (21)..(21): Xaa is Asp, Cys, Orn, homocysteine or acetyl phenylalanine
  MOD_RES (27)..(27): Xaa is Met, Leu or Nle
HSQGTFTSDYSKYLDSRRAQXFVQWLXDT

SEQ ID NO: 805 - protein, 29 aa, Artificial Sequence
  Synthetic peptide
  MOD_RES (24)..(24): Xaa is Gln, Cys, Orn, homocysteine or acetyl phenylalanine
  MOD_RES (27)..(27): Xaa is Met, Leu or Nle
HSQGTFTSDYSKYLDSRRAQDFVXWLXDT

SEQ ID NO: 806 - protein, 29 aa, Artificial Sequence
  Glucagon analogue
  MOD_RES (21)..(21): Xaa is Asp, Cys, Orn, homocysteine or acetyl phenyalanine
  MOD_RES (24)..(24): Xaa is Gln, Cys, Orn, homocysteine or acetyl phenyalanine
  MOD_RES (27)..(27): Xaa is Met, Leu or Nle
HSQGTFTSDYSKYLDSRRAQXFVXWLXDT

SEQ ID NO: 807 - protein, 29 aa, Artificial Sequence
  Glucagon analogue
  MOD_RES (27)..(27): Xaa is Met, Leu or Nle
  MOD_RES (28)..(28): Xaa is Lys, Arg, His, Asp, Glu, cysteic acid or homocysteic acid
  MOD_RES (29)..(29): Xaa is Thr, Lys, Arg, His, Asp, Glu, cysteic acid or homocysteic acid
HSQGTFTSDYSKYLDSRRAQDFVQWLXXX

SEQ ID NO: 808 - protein, 29 aa, Artificial Sequence
  Glucagon analogue
  MOD_RES (27)..(27): Xaa is Met, Leu or Nle
  MOD_RES (28)..(28): Xaa is Asp or Glu
  MOD_RES (29)..(29): Xaa is Thr, Asp or Glu
HSQGTFTSDYSKYLDSRRAQDFVQWLXXX

SEQ ID NO: 809 - protein, 29 aa, Artificial Sequence
  Glucagon analogue
  MOD_RES (27)..(27): Xaa is Met, Leu or Nle
  MOD_RES (29)..(29): Xaa is Asp or Glu
HSQGTFTSDYSKYLDSRRAQDFVQWLXNX

SEQ ID NO: 810 - protein, 29 aa, Artificial Sequence
  Synthetic peptide
  MOD_RES (27)..(27): Xaa is Met, Leu or Nle
HSQGTFTSDYSKYLDSRRAQDFVQWLXDT

SEQ ID NO: 811 - protein, 29 aa, Artificial Sequence
  Glucagon analogue
HSQGTFTSDYSKYLDSRRAQDFVQWLMDT

SEQ ID NO: 812 - protein, 29 aa, Artificial Sequence
  Glucagon analogue
  MOD_RES (29)..(29): Xaa is Lys, Arg or His
HSQGTFTSDYSKYLDSRRAQDFVQWLMNX

SEQ ID NO: 813 - protein, 29 aa, Artificial Sequence
  Glucagon analogue
HSQGTFTSDYSKYLESRRAQDFVQWLMDT

SEQ ID NO: 814 - protein, 29 aa, Artificial Sequence
  Synthetic peptide
  MOD_RES (16)..(16): Pegylation
  MOD_RES (27)..(27): Xaa is Met, Leu or Nle
HSQGTFTSDYSKYLDCRRAQDFVQWLXDT

SEQ ID NO: 815 - protein, 29 aa, Artificial Sequence
  Glucagon analogue
  MOD_RES (17)..(17): Pegylation
  MOD_RES (27)..(27): Xaa is Met, Leu or Nle
HSQGTFTSDYSKYLDSCRAQDFVQWLXDT

SEQ ID NO: 816 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSKYLDSRRAQCFVQWLXDT

SEQ ID NO: 817 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSKYLDSRRAQDFVCWLXDT

SEQ ID NO: 818 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSRYLDSRRAQKFVQWLXDT

SEQ ID NO: 819 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSRYLDSRRAQDFVKWLXDT

SEQ ID NO: 820 - protein, 10 aa, Artificial Sequence
  Synthetic peptide
  MISC_FEATURE: Peptide fragment representing carboxy terminal 10 amino acids of Exendin-4
GPSSGAPPPS

SEQ ID NO: 821 - protein, 8 aa, Artificial Sequence
  Synthetic peptide
  MISC_FEATURE: Peptide fragment representing the carboxy terminal 8 amino acids of oxyntomodulin
KRNRNNIA

SEQ ID NO: 822 - protein, 4 aa, Artificial Sequence
  Synthetic peptide
  MISC_FEATURE: Peptide fragment representing the amino 4 amino acids of oxyntomodulin carboxy terminus of SEQ ID NO: 21
KRNR

SEQ ID NO: 823 - protein, 10 aa, Artificial Sequence
  Synthetic peptide
  MISC_FEATURE: Peptide fragment representing the carboxy terminal 10 amino acids of Exendin-4
  MOD_RES (10)..(10): AMIDATION
GPSSGAPPPS

SEQ ID NO: 824 - protein, 39 aa, Artificial Sequence
  Glucagon analogue
HSQGTFTSDYSKYLDSRRAQDFVQWLMDTGPSSGAPPPS

SEQ ID NO: 825 - protein, 37 aa, Artificial Sequence
  Glucagon analogue
HSQGTFTSDYSKYLDSRRAQDFVQWLMDTKRNRNNIA

SEQ ID NO: 826 - protein, 33 aa, Artificial Sequence
  Glucagon analogue
HSQGTFTSDYSKYLDSRRAQDFVQWLMDTKRNR

SEQ ID NO: 827 - protein, 29 aa, Artificial Sequence
  Glucagon analogue
HSQGTFTSDYSKYLDSCRAQDFVQWLMNT

SEQ ID NO: 828 - protein, 39 aa, Artificial Sequence; identical to SEQ ID NO: 36
  Synthetic peptide

SEQ ID NO: 829 - protein, 29 aa, Artificial Sequence
  Glucagon analogue
  MOD_RES (24)..(24): 2-butyrolactone bound through Cys thiol group
HSQGTFTSDYSKYLDSRRAQDFVQWLMNT

SEQ ID NO: 830 - protein, 29 aa, Artificial Sequence
  Glucagon analogue
  MOD_RES (24)..(24): Carboxymethyl group bound through Cys thiol group
HSQGTFTSDYSKYLDSRRAQDFVQWLMNT

SEQ ID NO: 831 - protein, 39 aa, Artificial Sequence; identical to SEQ ID NO: 36
  Glucagon analogue

SEQ ID NO: 832 - protein, 30 aa, Artificial Sequence
  Glucagon analog
  MOD_RES (30)..(30): Xaa is Asp, Glu, Lys, Arg or His
HSQGTFTSDYSKYLDSRRAQDFVQWLMDTX

SEQ ID NO: 833 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn, Lys, Arg, His, Asp or Glu
  MOD_RES (29)..(29): Xaa is Thr, Lys, Arg, His, Asp or Glu
HSQGTFTSDYSKYLXSRRAQDFVQWLXXX

SEQ ID NO: 834 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn or an acidic amino acid
  MOD_RES (29)..(29): Xaa is Thr or an acidic amino acid
HSQGTFTSDYSKYLXSRRAQDFVQWLXXX

SEQ ID NO: 835 - protein, 39 aa, Artificial Sequence
  Synthetic peptide
HSQGTFTSDYSKYLDSRRAQDFVQWLMETGPSSGAPPPS

SEQ ID NO: 836 - protein, 37 aa, Artificial Sequence
  Glucagon analogue
HSQGTFTSDYSKYLDSRRAQDFVQWLMETKRNRNNIA

SEQ ID NO: 837 - protein, 33 aa, Artificial Sequence
  Glucagon analogue
HSQGTFTSDYSKYLDSRRAQDFVQWLMETKRNR

SEQ ID NO: 838 - protein, 29 aa, Artificial Sequence
  Glucagon analogue
HSQGTFTSDYSKYLDSRRAQDFVQWLMET

SEQ ID NO: 839 - protein, 27 aa, Artificial Sequence
  Synthetic peptide
  MOD_RES (1)..(1): Xaa is any amino acid
  MOD_RES (2)..(2): Xaa is any amino acid
  MOD_RES (27)..(27): Met comprises Z
XXQGTFTSDYSKYLDSRRAQDFVQWLM

SEQ ID NO: 840 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
XSQGTFTSDYSKYLDERRAKDFVCWLMNT

SEQ ID NO: 841 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Glutamine to alanine mutation
  MOD_RES (29)..(29): Pegylation
XSQGTFTSDYSKYLDERRAKDFVAWLMNC

SEQ ID NO: 842 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
  MOD_RES (27)..(27): Xaa is Nle or Leu
XSQGTFTSDYSKYLDERRAKDFVCWLXNT

SEQ ID NO: 843 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MISC_FEATURE (24)..(24): Glutamine to alanine mutation
  MISC_FEATURE (27)..(27): Xaa is Nle or Leu
  MOD_RES (29)..(29): Pegylation
XSQGTFTSDYSKYLDERRAKDFVAWLXNC

SEQ ID NO: 844 - protein, 29 aa, Artificial Sequence
  Synthetic peptide
  MISC_FEATURE: SEQ ID NO: 1 with  Ala 20, Ala 24, Nle 27, and Asp 28
  MOD_RES (27)..(27): Xaa is Nle
HSQGTFTSDYSKYLDSRRAADFVAWLXDT

SEQ ID NO: 845 - protein, 29 aa, Artificial Sequence
  Synthetic peptide
  MISC_FEATURE: SEQ ID NO: 1 with Ala 20, Ala 24, Nle27 , Asp 28, and Glu 29
  MOD_RES (27)..(27): Xaa is Nle
HSQGTFTSDYSKYLDSRRAADFVAWLXDE

SEQ ID NO: 846 - protein, 30 aa, Artificial Sequence
  Synthetic peptide
  MISC_FEATURE: SEQ ID NO: 1 with Ala 20, Ala 24, Nle 27, Asp 28, and Glu 30
  MOD_RES (27)..(27): Xaa is Nle
HSQGTFTSDYSKYLDSRRAADFVAWLXDTE

SEQ ID NO: 847 - protein, 29 aa, Artificial Sequence
  Synthetic peptide
  MISC_FEATURE: SEQ ID NO: 1 with Ala 20, Ala 24, Nle 27, Glu 28, and Glu 29
  MOD_RES (27)..(27): Xaa is Nle
HSQGTFTSDYSKYLDSRRAADFVAWLXEE

SEQ ID NO: 848 - protein, 30 aa, Artificial Sequence
  Synthetic peptide
  MISC_FEATURE: SEQ ID NO: 1 with Ala 20, Ala 24, Nle 27, Glu 28, and Glu 30
  MOD_RES (27)..(27): Xaa is Nle
HSQGTFTSDYSKYLDSRRAADFVAWLXETE

SEQ ID NO: 849 - protein, 30 aa, Artificial Sequence
  Synthetic peptide
  MOD_RES (27)..(27): Xaa is Nle
  MISC_FEATURE (27)..(27): SEQ ID NO: 1 with Ala 20, Ala 24, Nle 27, Glu 29, and Glu 30
HSQGTFTSDYSKYLDSRRAADFVAWLXNEE

SEQ ID NO: 850 - protein, 29 aa, Artificial Sequence
  Synthetic peptide
  MISC_FEATURE: SEQ ID NO: 1 with Ala 20, Glu 21, Ala 24, Nle 27, and Asp 28
  MOD_RES (27)..(27): Xaa is Nle
HSQGTFTSDYSKYLDSRRAAEFVAWLXDT

SEQ ID NO: 851 - protein, 29 aa, Artificial Sequence
  Synthetic peptide
  MISC_FEATURE: SEQ ID NO: 1 with Ala 20, Glu 21, Ala 24, Nle 27, Asp 28, and Glu 29
  MOD_RES (27)..(27): Xaa is Nle
HSQGTFTSDYSKYLDSRRAAEFVAWLXDE

SEQ ID NO: 852 - protein, 29 aa, Artificial Sequence
  Synthetic peptide
  MISC_FEATURE: SEQ ID NO: 1 with Ala 20, Glu 21, Ala 24, Nle 27, Asp 28, and Glu 30
  MOD_RES (27)..(27): Xaa is Nle
HSQGTFTSDYSKYLDSRRAAEFVAWLXDE

SEQ ID NO: 853 - protein, 29 aa, Artificial Sequence
  Synthetic peptide
  MISC_FEATURE: SEQ ID NO :1 with Ala 20, Glu 21, Ala 24, Nle 27, Glu 28, and Glu 29
  MOD_RES (27)..(27): Xaa is Nle
HSQGTFTSDYSKYLDSRRAAEFVAWLXEE

SEQ ID NO: 854 - protein, 29 aa, Artificial Sequence
  Synthetic peptide
  MISC_FEATURE: SEQ ID NO: 1 with Ala 20, Glu 21, Ala 24, Nle 27, Glu 28, and Glu 30
HSQGTFTSDYSKYLDSRRAQDFVQWLMNT

SEQ ID NO: 855 - protein, 30 aa, Artificial Sequence
  Synthetic peptide
  MISC_FEATURE: SEQ ID NO: 1 with Ala 20, Glu 21, Ala 24, Nle 27, Glu 29, and Glu 30
  MOD_RES (27)..(27): Xaa is Nle
HSQGTFTSDYSKYLDSRRAAEFVAWLXNEE

SEQ ID NO: 856 - protein, 29 aa, Artificial Sequence
  Synthetic peptide
  MISC_FEATURE: SEQ ID NO: 1 with Thr 16, Ala 20, Glu 21, Ala 24, Nle 27, Asp 28, and Glu29
  MOD_RES (27)..(27): Xaa is Nle
HSQGTFTSDYSKYLDTRRAAEFVAWLXDE

SEQ ID NO: 857 - protein, 31 aa, Homo sapiens; identical to SEQ ID NO: 50

SEQ ID NO: 858 - protein, 30 aa, Homo sapiens; identical to SEQ ID NO: 52
  MOD_RES (30)..(30): AMIDATION

SEQ ID NO: 859 - protein, 29 aa, Artificial Sequence
  Synthetic peptide
  MOD_RES (3)..(3): Xaa is Glutamine analog
  MOD_RES (27)..(27): Xaa is Nle
HSXGTFTSDYSKYLDTRRAAEFVAWLXDE

SEQ ID NO: 860 - protein, 29 aa, Artificial Sequence
  Synthetic peptide
  MOD_RES (3)..(3): Xaa is Glutamine analog
  MOD_RES (16)..(16): Xaa is Aminoisobutryic acid
HSXGTFTSDYSKYLDXRRAADFVAWLMDE

SEQ ID NO: 861 - protein, 29 aa, Artificial Sequence
  Synthetic peptide
  MOD_RES (27)..(27): Xaa is Nle
HSQGTFTSDYSKYLDTRRAAEFVAWLXDE

SEQ ID NO: 862 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 863 - protein, 29 aa, Artificial Sequence
  Synethic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 864 - protein, 29 aa, Artificial Sequence
  Synthetic peptide
  MOD_RES (3)..(3): Xaa is Carbamoyldiaminopropanoic acid
  MOD_RES (27)..(27): Xaa is Nle
HSXGTFTSDYSKYLDTRRAAEFVAWLXDE

SEQ ID NO: 865 - protein, 29 aa, Artificial Sequence
  Synthetic peptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 866 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 867 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 868 - protein, 29 aa, Artificial Sequence
  Synthetic peptide
  MOD_RES (16)..(16): Xaa is Aminoisobutryic acid
HSQGTFTSDYSKYLDXRRAADFVAWLMDE

SEQ ID NO: 869 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRAADFVAWLMDE

SEQ ID NO: 870 - protein, 29 aa, Artificial Sequence
  Synthetic peptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 871 - protein, 29 aa, Artificial Sequence
  Synthetic peptide
  MOD_RES (3)..(3): Xaa is acetyldiaminobutanoic acid
  MOD_RES (16)..(16): Xaa is Aib
HSXGTFTSDYSKYLDXRRAADFVAWLLDE

SEQ ID NO: 872 - protein, 39 aa, Artificial Sequence; identical to SEQ ID NO: 604
  Synthetic peptide
  MOD_RES (3)..(3): Xaa is Acetyldiaminobutanoic acid
  MOD_RES (16)..(16): Aminoisobutryic Acid
  MOD_RES (39)..(39): AMIDATION

SEQ ID NO: 873 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryric acid
HSXGTFTSDYSKYLDXRRASDFVSWLLDE

SEQ ID NO: 874 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRATDFVTWLLDE

SEQ ID NO: 875 - protein, 29 aa, Artificial Sequence
  Synthetic peptide
HSQGTFTSDYSKYLDSRRAQDFVQWLMDE

SEQ ID NO: 876 - protein, 29 aa, Artificial Sequence
  Synthetic peptide
  MOD_RES (16)..(16): Xaa is Aib
HSQGTFTSDYSKYLDXRRAQDFVQWLMDE

SEQ ID NO: 877 - protein, 29 aa, Artificial Sequence
  Synthetic peptide
  misc_feature (3)..(3): Xaa can be any naturally occurring amino acid
HSXGTFTSDYSKYLDSRRAQDFVQWLMNT

SEQ ID NO: 878 - protein, 29 aa, Artificial Sequence
  Synthetic peptide
HSQGTFTSDYSKYLDSRRAQDFVQWLMDT

SEQ ID NO: 879 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C14 fatty acyl group
  MOD_RES (30)..(30): AMIDATION

SEQ ID NO: 880 - protein, 29 aa, Artificial Sequence
  Synthetic peptide
  MOD_RES (2)..(2): Xaa is d-Ser
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 881 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C16 fatty acyl group
  MOD_RES (30)..(30): AMIDATION

SEQ ID NO: 882 - protein, 29 aa, Artificial Sequence
  Synthetic peptide
  MOD_RES (2)..(2): Xaa is d-Ser
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 883 - protein, 29 aa, Artificial Sequence
  Synthetic peptide
  MOD_RES (2)..(2): Aminoisobutryic Acid
  MOD_RES (10)..(10): Acylated with a C18 fatty acyl group
  MOD_RES (24)..(24): Cys-PEG
  MOD_RES (29)..(29): AMIDATION
HXQGTFTSDKSKYLDEQAAKEFICWLMNT

SEQ ID NO: 884 - protein, 30 aa, Artificial Sequence; identical to SEQ ID NO: 586
  Synthetic peptide
  MOD_RES (2)..(2): Aminoisobutryic Acid
  MOD_RES (24)..(24): Cys-PEG
  MOD_RES (30)..(30): Acylated with a C18 fatty acyl group
  MOD_RES (30)..(30): AMIDATION

SEQ ID NO: 885 - protein, 29 aa, Artificial sequence
  Synthetic peptide
  MOD_RES (16)..(16): Xaa is Ser or alpha, alpha-disubstituted amino acid
  MOD_RES (20)..(20): Xaa is Gln or alpha, alpha-disubstituted amino acid
  MOD_RES (21)..(21): Xaa is Asp or alpha, alpha-disubstituted amino acid
  MOD_RES (24)..(24): Xaa is Gln or alpha, alpha-disubstituted amino acid
HSQGTFTSDYSKYLDXRRAXXFVXWLMNT

SEQ ID NO: 886 - protein, 29 aa, Artificial Sequence
  Synthetic peptide
  MOD_RES (16)..(16): Xaa is Aib
HSQGTFTSDYSKYLDXRRAQDFVQWLMNT

SEQ ID NO: 887 - protein, 29 aa, Artificial Sequence
  Synthetic peptide
  MOD_RES (19)..(19): Xaa is Aib
HSQGTFTSDYSKYLDSRRXQDFVQWLMNT

SEQ ID NO: 888 - protein, 29 aa, Artificial Sequence
  Synthetic peptide
  MOD_RES (20)..(20): Xaa is Aib
HSQGTFTSDYSKYLDSRRAXDFVQWLMNT

SEQ ID NO: 889 - protein, 29 aa, Artificial Sequence
  Synthetic peptide
  MOD_RES (21)..(21): Xaa is Aib
HSQGTFTSDYSKYLDSRRAQXFVQWLMNT

SEQ ID NO: 890 - protein, 29 aa, Artificial Sequence
  Synthetic peptide
  MOD_RES (24)..(24): Xaa is Aib
HSQGTFTSDYSKYLDSRRAQDFVXWLMNT

SEQ ID NO: 891 - protein, 29 aa, Artificial Sequence
  Synthetic peptide
  MOD_RES (16)..(16): Xaa is Aib
  MOD_RES (20)..(20): Xaa is Aib
HSQGTFTSDYSKYLDXRRAXDFVQWLMNT

SEQ ID NO: 892 - protein, 29 aa, Artificial Sequence
  Synthetic peptide
  MOD_RES (16)..(16): Xaa is Aib
  MOD_RES (24)..(24): Xaa is Aib
HSQGTFTSDYSKYLDXRRAQDFVXWLMNT

SEQ ID NO: 893 - protein, 29 aa, Artificial Sequence
  Synthetic peptide
  MOD_RES (20)..(20): Xaa is Aib
  MOD_RES (24)..(24): Xaa is Aib
HSQGTFTSDYSKYLDSRRAXDFVXWLMNT

SEQ ID NO: 894 - protein, 29 aa, Artificial Sequence
  Synthetic peptide
  MOD_RES (16)..(16): Xaa is Aib
  MOD_RES (20)..(20): Xaa is Aib
  MOD_RES (24)..(24): Xaa is Aib
HSQGTFTSDYSKYLDXRRAXDFVXWLMNT

SEQ ID NO: 895 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDKSKYLDXRRAQDFVQWLMNT

SEQ ID NO: 896 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 897 - protein, 29 aa, Artificial Sequence
  Synthetic peptide
  MOD_RES (2)..(2): Xaa is Aib
  MOD_RES (10)..(10): Acylated with a C16 fatty acyl group
  MOD_RES (16)..(16): Xaa is Aib
  MOD_RES (29)..(29): AMIDATION
HXQGTFTSDKSKYLDXRRAQDFVQWLMNT

SEQ ID NO: 898 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 899 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 900 - protein, 29 aa, Artificial Sequence
  Synthetic peptide
  MOD_RES (2)..(2): Xaa is Aib
  MOD_RES (10)..(10): Acylated with a C16 fatty acyl group via beta-Ala-beta-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 901 - protein, 29 aa, Artificial Sequence
  Synthetic peptide
  MOD_RES (2)..(2): Xaa is Aib
  MOD_RES (10)..(10): Acylated with a C16 fatty acyl group via 6-aminohexanoic acid spacer
  MOD_RES (16)..(16): Xaa is Aib
  MOD_RES (29)..(29): AMIDATION
HXQGTFTSDKSKYLDXRRAQDFVQWLMNT

SEQ ID NO: 902 - protein, 29 aa, Artificial Sequence
  Synthetic peptide
  MOD_RES (2)..(2): Xaa is Aib
  MOD_RES (10)..(10): Acylated with a C16 fatty acyl group via Leu-Leu spacer
  MOD_RES (16)..(16): Xaa is Aib
  MOD_RES (29)..(29): AMIDATION
HXQGTFTSDKSKYLDXRRAQDFVQWLMNT

SEQ ID NO: 903 - protein, 29 aa, Artificial Sequence
  Synthetic peptide
  MOD_RES (2)..(2): Xaa is Aib
  MOD_RES (10)..(10): Acylated with a C16 fatty acyl group via Pro-Pro spacer
  MOD_RES (16)..(16): Xaa is Aib
  MOD_RES (29)..(29): AMIDATION
HXQGTFTSDKSKYLDXRRAQDFVQWLMNT

SEQ ID NO: 904 - protein, 29 aa, Artificial Sequence
  Synthetic peptide
  MOD_RES (2)..(2): Xaa is Aib
  MOD_RES (10)..(10): Acylated with a C14 fatty acyl group
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 905 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 906 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 907 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 908 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 909 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 910 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 911 - protein, 29 aa, Artificial Sequence
  Synthetic peptide
  MOD_RES (2)..(2): Xaa is Aib
  MOD_RES (10)..(10): Covalently bound to a C14 fatty acyl group
  MOD_RES (16)..(16): Xaa is Aib
  MOD_RES (29)..(29): AMIDATION
HXQGTFTSDKSKYLDXRRAQDFVCWLMNT

SEQ ID NO: 912 - protein, 29 aa, Artificial Sequence
  Synthetic peptide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 913 - protein, 29 aa, Artificial Sequence
  Synthetic peptide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 914 - protein, 29 aa, Artificial Sequence
  Synthetic peptide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 915 - protein, 29 aa, Artificial Sequence
  Synthetic peptide
  MOD_RES (2)..(2): Xaa is Aib
  MOD_RES (10)..(10): Covelently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 916 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group
  MOD_RES (30)..(30): AMIDATION

SEQ ID NO: 917 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 918 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group
  MOD_RES (30)..(30): AMIDATION

SEQ ID NO: 919 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 920-1000 - skipped (81 entries)

SEQ ID NO: 1001 - protein, 29 aa, Homo sapiens
  MISC_FEATURE: Wild type glucagon
HSQGTFTSDYSKYLDSRRAQDFVQWLMNT

SEQ ID NO: 1002 - protein, 31 aa, Homo sapiens; identical to SEQ ID NO: 50
  MISC_FEATURE (1)..(31): GLP-1(7-37)

SEQ ID NO: 1003 - protein, 30 aa, Artificial sequence; identical to SEQ ID NO: 52
  Synthetic polypeptide
  MISC_FEATURE (1)..(30): GLP-1(7-36) amidated
  MISC_FEATURE (30)..(30): C-terminal amidation

SEQ ID NO: 1004 - protein, 42 aa, Homo sapiens
  mat_peptide (1)..(42): gastric inhibitory polypeptide
YAEGTFISDYSIAMDKIHQQDFVNWLLAQKGKKNDWKHNITQ

SEQ ID NO: 1005 - protein, 29 aa, Artificial sequence
  Synthetic polypeptide
  MISC_FEATURE: Analog 61
  MISC_FEATURE (16)..(20): Lactam bridge between residues 16 and 20.
HSQGTFTSDYSKYLDEIHQKEFIAWLMNT

SEQ ID NO: 1006 - protein, 29 aa, Artificial sequence
  Synthetic polypeptide
  MISC_FEATURE: Analog 62
  MISC_FEATURE (16)..(20): Lactam bridge between residues 16 and 20.
HSQGTFTSDYSIYLDEIHQKEFIAWLMNT

SEQ ID NO: 1007 - protein, 29 aa, Artificial sequence
  Synthetic polypeptide
  MISC_FEATURE: Analog 63
  MISC_FEATURE (12)..(16): Lactam bridge between residues 12 and 16.
HSQGTFTSDYSKYLDEIHQKEFIAWLMNT

SEQ ID NO: 1008 - protein, 29 aa, Artificial sequence
  Synthetic polypeptide
  MISC_FEATURE: Analog 66
HSQGTFTSDYSKYLDEIHQKEFIAWLLAQ

SEQ ID NO: 1009 - protein, 29 aa, Artificial sequence
  Synthetic polypeptide
  MISC_FEATURE: Analog 68
HSQGTFTSDYSKYLDKIHQEEFIAWLMNT

SEQ ID NO: 1010 - protein, 29 aa, Artificial sequence
  Synthetic polypeptide
  MISC_FEATURE: Analog 69
  MISC_FEATURE (16)..(20): Lactam bridge between residues 16 and 20
HSQGTFTSDYSKYLDKIHQEEFIAWLMNT

SEQ ID NO: 1011 - protein, 29 aa, Artificial sequence
  Synthetic polypeptide
  MISC_FEATURE: Analog 84
  MISC_FEATURE (16)..(20): Lactam bridge between residues 16 and 20
HSQGTFTSDYSIYLDEIHQKEFICWLLAQ

SEQ ID NO: 1012 - protein, 29 aa, Artificial sequence
  Synthetic polypeptide
  MISC_FEATURE: Analog 85
  MISC_FEATURE (16)..(20): Lactam bridge between residues 16 and 20
  MISC_FEATURE (24)..(24): PEG (20kDa) covalently attached to Cysteine
HSQGTFTSDYSIYLDEIHQKEFICWLLAQ

SEQ ID NO: 1013 - protein, 29 aa, Artificial sequence
  Synthetic polypeptide
  MISC_FEATURE: Analog 92
HSQGTFTSDYSIYLDEKHQKEFIAWLLAQ

SEQ ID NO: 1014 - protein, 29 aa, Artificial sequence
  Synthetic polypeptide
  MISC_FEATURE: Analog 93
  MISC_FEATURE (16)..(20): Lactam bridge between residues 16 and 20
  MISC_FEATURE (17)..(21): Lactam bridge between residues 17 and 21
HSQGTFTSDYSIYLDEKHQKEFIAWLLAQ

SEQ ID NO: 1015 - protein, 29 aa, Artificial sequence
  Synthetic polypeptide
  MISC_FEATURE: Analog 95
  MISC_FEATURE (16)..(20): Lactam bridge between residues 16 and 20
HAEGTFISDYSIAMDEIHQKDFVNWLLAQ

SEQ ID NO: 1016 - protein, 29 aa, Artificial sequence
  Synthetic polypeptide
  MISC_FEATURE: Analog 96
  MISC_FEATURE (16)..(20): Lactam bridge between residues 16 and 20
YAEGTFISDYSIAMDEIHQKDFVNWLLAQ

SEQ ID NO: 1017 - protein, 29 aa, Artificial sequence
  Synthetic polypeptide
  MISC_FEATURE: Analog 97
  MISC_FEATURE (16)..(20): Lactam bridge between residues 16 and 20
HAEGTFTSDYSIYMDEIHQKDFVNWLLAQ

SEQ ID NO: 1018 - protein, 29 aa, Artificial sequence
  Synthetic polypeptide
  MISC_FEATURE: Analog 98
  MISC_FEATURE (16)..(20): Lactam bridge between residues 16 and 20
YAEGTFTSDYSIYMDEIHQKDFVNWLLAQ

SEQ ID NO: 1019 - protein, 42 aa, Artificial sequence
  Synthetic polypeptide
  MISC_FEATURE: Analog 99
YAEGTFISDYSIAMDKIHQQDFVNWLLAQKGKKNWLKHNITQ

SEQ ID NO: 1020 - protein, 42 aa, Artificial sequence
  Synthetic polypeptide
  MISC_FEATURE: Analog 100
  MOD_RES (2)..(2): Xaa is Aib
YXEGTFISDYSIAMDKIHQQDFVNWLLAQKGKKNWLKHNITQ

SEQ ID NO: 1021 - protein, 42 aa, Artificial sequence
  Synthetic polypeptide
  MISC_FEATURE: Analog 101
YAPGTFISDYSIAMDKIHQQDFVNWLLAQKGKKNWLKHNITQ

SEQ ID NO: 1022 - protein, 42 aa, Artificial sequence
  Synthetic polypeptide
  MISC_FEATURE: Analog 102
  MOD_RES (2)..(2): Xaa is Aib
YXEGTFISDYSIAMDKIHQQDFVCWLLAQKGKKNWLKHNITQ

SEQ ID NO: 1023 - protein, 42 aa, Artificial sequence
  Synthetic polypeptide
  MISC_FEATURE: Analog 104
YAPGTFISDYSIAMDKIHQQDFVCWLLAQKGKKNWLKHNITQ

SEQ ID NO: 1024 - protein, 42 aa, Artificial sequence; identical to SEQ ID NO: 1023
  Synthetic polypeptide
  MISC_FEATURE: Analog 105
  MISC_FEATURE (24)..(24): PEG (40kDa) attached to Cysteine

SEQ ID NO: 1025 - protein, 29 aa, Artificial sequence
  Synthetic polypeptide
  MISC_FEATURE: Analog 106
YAEGTFISDYSIAMDKIHQQDFVNWLLAQ

SEQ ID NO: 1026 - protein, 29 aa, Artificial sequence
  Synthetic polypeptide
  MISC_FEATURE: Analog 107
  MISC_FEATURE (16)..(20): Lactam bridge between residues 16 and 20
HSQGTFISDYSKYLDEIHQKEFIAWLMNT

SEQ ID NO: 1027 - protein, 29 aa, Artificial sequence
  Synthetic polypeptide
  MISC_FEATURE: Analog 108
  MISC_FEATURE (16)..(20): Lactam bridge between residues 16 and 20
HSQGTFISDYSKALDEIHQKEFIAWLMNT

SEQ ID NO: 1028 - protein, 29 aa, Artificial sequence
  Synthetic polypeptide
  MISC_FEATURE: Analog 109
  MISC_FEATURE (16)..(20): Lactam bridge between residues 16 and 20
YSQGTFTSDYSKYLDEIHQKDFVNWLLAQ

SEQ ID NO: 1029 - protein, 29 aa, Artificial sequence
  Synthetic polypeptide
  MISC_FEATURE: Analog 110
  MISC_FEATURE (16)..(20): Lactam bridge between residues 16 and 20
YSQGTFTSDYSIYLDEIHQKDFVNWLLAQ

SEQ ID NO: 1030 - protein, 29 aa, Artificial sequence
  Synthetic polypeptide
  MISC_FEATURE: Analog 111
  MISC_FEATURE (16)..(20): Lactam bridge between residues 16 and 20
HSQGTFTSDYSKYLDEIHQKDFVNWLLAQ

SEQ ID NO: 1031 - protein, 24 aa, Artificial sequence
  Synthetic polypeptide
  MISC_FEATURE: Analog 113
  MOD_RES (1)..(1): Xaa is 3-phenyllactic acid
  MISC_FEATURE (11)..(15): Lactam bridge between residues 11 and 15
XISDYSIAMDEIHQKDFVNWLLAQ

SEQ ID NO: 1032 - protein, 24 aa, Artificial sequence
  Synthetic polypeptide
  MISC_FEATURE: Analog 114
  MOD_RES (1)..(1): Xaa is 3-phenyllactic acid
  MISC_FEATURE (11)..(15): Lactam bridge between residues 11 and 15
XTSDYSKYLDEIHQKDFVNWLLAQ

SEQ ID NO: 1033 - protein, 39 aa, Artificial sequence
  Synthetic polypeptide
  MISC_FEATURE: Analog 115
  MISC_FEATURE (16)..(20): Lactam bridge between residues 16 and 20
HSQGTFTSDYSKYLDEIHQKDFVNWLLAGGPSSGAPPPS

SEQ ID NO: 1034 - protein, 39 aa, Artificial sequence
  Synthetic polypeptide
  MISC_FEATURE: Analog 116
  MISC_FEATURE (16)..(20): Lactam bridge between residues 16 and 20
YSQGTFTSDYSKYLDEIHQKDFVNWLLAGGPSSGAPPPS

SEQ ID NO: 1035 - protein, 29 aa, Artificial sequence
  Synthetic polypeptide
  MISC_FEATURE: Analog 118
  MISC_FEATURE (16)..(20): Lactam bridge between residues 16 and 20
YSQGTFTSDYSKYLDEIHQKEFVNWLLAQ

SEQ ID NO: 1036 - protein, 39 aa, Artificial sequence
  Synthetic polypeptide
  MISC_FEATURE: Analog 120
  MISC_FEATURE (16)..(20): Lactam bridge between residues 16 and 20
YSQGTFTSDYSKYLDEQAAKEFIAWLMNGGPSSGAPPPS

SEQ ID NO: 1037 - protein, 29 aa, Artificial sequence
  Synthetic polypeptide
  MISC_FEATURE: Analog 124
  MISC_FEATURE (16)..(20): Lactam bridge between residues 16 and 20
HSQGTFTSDYSIYMDEIHQKDFVNWLLAQ

SEQ ID NO: 1038 - protein, 29 aa, Artificial sequence
  Synthetic polypeptide
  MISC_FEATURE: Analog 125
  MISC_FEATURE (16)..(20): Lactam bridge between residues 16 and 20
YSQGTFTSDYSIYMDEIHQKDFVNWLLAQ

SEQ ID NO: 1039 - protein, 39 aa, Artificial sequence
  Synthetic polypeptide
  MISC_FEATURE: Analog 127
  MISC_FEATURE (16)..(20): Lactam bridge between residues 16 and 20
YSQGTFTSDYSKYLDEQAAKEFVNWLLAGGPSSGAPPPS

SEQ ID NO: 1040 - protein, 39 aa, Artificial sequence
  Synthetic polypeptide
  MISC_FEATURE: Analog 128
  MISC_FEATURE (16)..(20): Lactam bridge between residues 16 and 20
HSQGTFTSDYSKYLDEIHQKDFIAWLMNGGPSSGAPPPS

SEQ ID NO: 1041 - protein, 39 aa, Artificial sequence
  Synthetic polypeptide
  MISC_FEATURE: Analog 129
  MISC_FEATURE (16)..(20): Lactam bridge between residues 16 and 20
YSQGTFTSDYSKYLDEIHQKDFIAWLMNGGPSSGAPPPS

SEQ ID NO: 1042 - protein, 39 aa, Artificial sequence
  Synthetic polypeptide
  MISC_FEATURE: Analog 139
  MISC_FEATURE (16)..(20): Lactam bridge between residues 16 and 20
YSQGTFTSDYSKYLDEQAAKEFIAWLLAGGPSSGAPPPS

SEQ ID NO: 1043 - protein, 39 aa, Artificial sequence
  Synthetic polypeptide
  MISC_FEATURE: Analog 140
  MISC_FEATURE (16)..(20): Lactam bridge between residues 16 and 20
YSQGTFTSDYSIYLDEQAAKEFVNWLLAGGPSSGAPPPS

SEQ ID NO: 1044 - protein, 39 aa, Artificial sequence
  Synthetic polypeptide
  MISC_FEATURE: Analog 141
  MISC_FEATURE (16)..(20): Lactam bridge between residuess 16 and 20
YSQGTFTSDYSKYMDEQAAKEFVNWLLAGGPSSGAPPPS

SEQ ID NO: 1045 - protein, 39 aa, Artificial sequence
  Synthetic polypeptide
  MISC_FEATURE: Analog 142
  MISC_FEATURE (16)..(20): Lactam bridge between residues 16 and 20
YAEGTFTSDYSIYMDEQAAKEFVNWLLAGGPSSGAPPPS

SEQ ID NO: 1046 - protein, 39 aa, Artificial sequence
  Synthetic polypeptide
  MISC_FEATURE: Analog 143
  MISC_FEATURE (16)..(20): Lactam bridge between residues 16 and 20
YSQGTFTSDYSKYLDERRAKEFVNWLLAGGPSSGAPPPS

SEQ ID NO: 1047 - protein, 39 aa, Artificial sequence
  Synthetic polypeptide
  MISC_FEATURE: Analog 144
  MISC_FEATURE (16)..(20): Lactam bridge between residues 16 and 20
YAQGTFTSDYSIYMDEQAAKEFVNWLLAGGPSSGAPPPS

SEQ ID NO: 1048 - protein, 39 aa, Artificial sequence
  Synthetic polypeptide
  MISC_FEATURE: Analog 145
  MISC_FEATURE (16)..(20): Lactam bridge between residues 16 and 20
YAQGTFISDYSKYLDEQAAKEFVNWLLAGGPSSGAPPPS

SEQ ID NO: 1049 - protein, 39 aa, Artificial sequence; identical to SEQ ID NO: 1048
  Synthetic polypeptide
  MISC_FEATURE: Analog 146
  MISC_FEATURE (16)..(20): Lactam bridge between residues 16 and 20

SEQ ID NO: 1050 - protein, 39 aa, Artificial sequence
  Synthetic polypeptide
  MISC_FEATURE: Analog 147
  MISC_FEATURE (16)..(20): Lactam bridge between residues 16 and 20
YSQGTFTSDYSIYLDEQAAKEFIAWLLAGGPSSGAPPPS

SEQ ID NO: 1051 - protein, 39 aa, Artificial sequence
  Synthetic polypeptide
  MISC_FEATURE: Analog 148
  MISC_FEATURE (16)..(20): Lactam bridge between residues 16 and 20
YSEGTFTSDYSIYLDEQAAKEFIAWLLAGGPSSGAPPPS

SEQ ID NO: 1052 - protein, 39 aa, Artificial sequence
  Synthetic polypeptide
  MISC_FEATURE: Analog 149
  MISC_FEATURE (16)..(20): Lactam bridge between residues 16 and 20
YAEGTFTSDYSIYLDEQAAKEFVNWLLAGGPSSGAPPPS

SEQ ID NO: 1053 - protein, 39 aa, Artificial sequence
  Synthetic polypeptide
  MISC_FEATURE: Analog 150
  MISC_FEATURE (16)..(20): Lactam bridge between residues 16 and 20
YSQGTFISDYSIYLDEQAAKEFVNWLLAGGPSSGAPPPS

SEQ ID NO: 1054 - protein, 39 aa, Artificial sequence; identical to SEQ ID NO: 1042
  Synthetic polypeptide
  MISC_FEATURE: Analog 151
  MISC_FEATURE (16)..(20): Lactam bridge between residues 16 and 20

SEQ ID NO: 1055 - protein, 39 aa, Artificial sequence
  Synthetic polypeptide
  MISC_FEATURE: Analog 152
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPS

SEQ ID NO: 1056 - protein, 39 aa, Artificial sequence
  Synthetic polypeptide
  MISC_FEATURE: Analog 154
  MOD_RES (1)..(1): Xaa is hippuric acid
  MISC_FEATURE (16)..(20): Lactam bridge between residues 16 and 20
XSQGTFTSDYSIYLDEQAAKEFVNWLLAGGPSSGAPPPS

SEQ ID NO: 1057 - protein, 39 aa, Artificial sequence; identical to SEQ ID NO: 1039
  Synthetic polypeptide
  MISC_FEATURE: Analog 155
  MISC_FEATURE (12)..(16): Lactam bridge between residues 12 and 16

SEQ ID NO: 1058 - protein, 39 aa, Artificial sequence
  Synthetic polypeptide
  MISC_FEATURE: Analog 156
  MISC_FEATURE (20)..(24): Lactam bridge between residues 20 and 24
YSQGTFTSDYSIYLDEQAAKEFVEWLLAGGPSSGAPPPS

SEQ ID NO: 1059 - protein, 39 aa, Artificial sequence
  Synthetic polypeptide
  MISC_FEATURE: Analog 157
  MISC_FEATURE (24)..(28): Lactam bridge between residues 24 and 28
YSQGTFTSDYSIYLDEQAAKEFVEWLLKGGPSSGAPPPS

SEQ ID NO: 1060 - protein, 39 aa, Artificial sequence
  Synthetic polypeptide
  MISC_FEATURE: Analog 158
  MOD_RES (2)..(2): Xaa is Aib
  MISC_FEATURE (16)..(20): Lactam bridge between residues 16 and 20
YXQGTFTSDYSIYLDEQAAKEFVCWLLAGGPSSGAPPPS

SEQ ID NO: 1061 - protein, 39 aa, Artificial sequence
  Synthetic polypeptide
  MISC_FEATURE: Analog 162
  MOD_RES (2)..(2): Xaa is Aib
  MISC_FEATURE (16)..(20): Lactam bridge between residues 16 and 20
YXQGTFTSDYSYYLDEQAVKEFVNWLIAGGPSSGAPPPS

SEQ ID NO: 1062 - protein, 29 aa, Artificial sequence
  Synthetic polypeptide
  MISC_FEATURE: Analog 163
  MISC_FEATURE (16)..(20): Lactam bridge between residues 16 and 20
YSQGTFTSDYSIYLDEQAAKEFVNWLLAG

SEQ ID NO: 1063 - protein, 29 aa, Artificial sequence
  Synthetic polypeptide
  MISC_FEATURE: Analog 164
  MOD_RES (2)..(2): Xaa is Aib
  MISC_FEATURE (16)..(20): Lactam bridge between residues 16 and 20
YXQGTFTSDYSIYLDEQAAKEFVNWLLAG

SEQ ID NO: 1064 - protein, 40 aa, Artificial sequence
  Synthetic polypeptide
  MISC_FEATURE: Analog 165
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPSC

SEQ ID NO: 1065 - protein, 40 aa, Artificial sequence; identical to SEQ ID NO: 1064
  Synthetic polypeptide
  MISC_FEATURE: Analog 166
  MOD_RES (2)..(2): Xaa is d-alanine
  MISC_FEATURE (16)..(20): Lactam bridge between residues 16 and 20

SEQ ID NO: 1066 - protein, 39 aa, Artificial sequence
  Synthetic polypeptide
  MISC_FEATURE: Analog 167
  MISC_FEATURE (17)..(20): Lactam bridge between residues 17 and 20
YSQGTFTSDYSIYLDEEAAKEFVNWLLAGGPSSGAPPPS

SEQ ID NO: 1067 - protein, 39 aa, Artificial sequence
  Synthetic polypeptide
  MISC_FEATURE: Analog 168
  MISC_FEATURE (18)..(21): Lactam bridge between residues 18 and 21
YSQGTFTSDYSIYLDEQKAKEFVNWLLAGGPSSGAPPPS

SEQ ID NO: 1068 - protein, 29 aa, Artificial sequence
  Synthetic polypeptide
  MISC_FEATURE: Analog 169
  MOD_RES (2)..(2): Xaa is Aib
  MISC_FEATURE (16)..(20): Lactam bridge between residues 16 and 20
YXQGTFTSDYSIYLDEQAAKEFVCWLLAG

SEQ ID NO: 1069 - protein, 40 aa, Artificial sequence; identical to SEQ ID NO: 1064
  Synthetic polypeptide
  MISC_FEATURE: Analog 170
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1070 - protein, 29 aa, Artificial sequence
  Synthetic polypeptide
  MISC_FEATURE: Analog 172
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLLAG

SEQ ID NO: 1071 - protein, 40 aa, Artificial sequence
  Synthetic polypeptide
  MISC_FEATURE: Analog 174
  MOD_RES (2)..(2): Xaa is Aib
  MISC_FEATURE (16)..(20): Lactam bridge between residues 16 and 20
YXEGTFTSDYSIYLDEQAAKEFVNWLLAGGPSSGAPPPSC

SEQ ID NO: 1072 - protein, 39 aa, Artificial sequence; identical to SEQ ID NO: 1060
  Synthetic polypeptide
  MISC_FEATURE: Analog 175
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine

SEQ ID NO: 1073 - protein, 40 aa, Artificial sequence
  Synthetic polypeptide
  MISC_FEATURE: Analog 176
  MOD_RES (2)..(2): Xaa is Aib
  MISC_FEATURE (16)..(20): Lactam bridge between residues 16 and 20
YXQGTFISDYSIYLDEQAAKEFVNWLLAGGPSSGAPPPSC

SEQ ID NO: 1074 - protein, 29 aa, Artificial sequence
  Synthetic polypeptide
  MISC_FEATURE: Analog 177
  MOD_RES (2)..(2): Xaa is Aib
  MISC_FEATURE (16)..(20): Lactam bridge between residues 16 and 20
YXQGTFISDYSIYLDEQAAKEFVCWLLAG

SEQ ID NO: 1075 - protein, 40 aa, Artificial sequence; identical to SEQ ID NO: 1071
  Synthetic polypeptide
  MISC_FEATURE: Analog 178
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1076 - protein, 29 aa, Artificial sequence
  Synthetic polypeptide
  MISC_FEATURE: Analog 179
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFISDYSIYLDEQAAKEFVCWLLAG

SEQ ID NO: 1077 - protein, 40 aa, Artificial sequence; identical to SEQ ID NO: 1073
  Synthetic polypeptide
  MISC_FEATURE: Analog 182
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1078 - protein, 29 aa, Artificial sequence
  Synthetic polypeptide
  MISC_FEATURE: Analog 186
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLMNG

SEQ ID NO: 1079 - protein, 39 aa, Artificial sequence; identical to SEQ ID NO: 1055
  Synthetic polypeptide
  MISC_FEATURE: Analog 191
  MOD_RES (2)..(2): Xaa is Aib

SEQ ID NO: 1080 - protein, 34 aa, Artificial sequence
  Synthetic polypeptide
  MISC_FEATURE: Analog 192
FTSDYSIYLDEQAAKEFVNWLLAGGPSSGAPPPS

SEQ ID NO: 1081 - protein, 38 aa, Artificial sequence
  Synthetic polypeptide
  MISC_FEATURE: Analog 194
  MOD_RES (1)..(1): Xaa is Aib
XQGTFTSDYSIYLDEEAVRLFVNWLLAGGPSSGAPPPS

SEQ ID NO: 1082 - protein, 26 aa, Artificial sequence
  Synthetic polypeptide
  MISC_FEATURE: Analog 197
  MISC_FEATURE (13)..(17): Lactam bridge between residues 13 and 17
GTFTSDYSIYLDEQAAKEFVNWLLAG

SEQ ID NO: 1083 - protein, 28 aa, Artificial sequence
  Synthetic polypeptide
  MISC_FEATURE: Analog 198
  MOD_RES (1)..(1): Xaa is Aib
  MISC_FEATURE (15)..(19): Lactam bridge between residues 15 and 19
XQGTFTSDYSIYLDEQAAKEFVNWLLAG

SEQ ID NO: 1084 - protein, 40 aa, Artificial sequence
  Synthetic polypeptide
  MISC_FEATURE: Analog 199
  MOD_RES (2)..(2): Xaa is Aib
  MISC_FEATURE (16)..(20): Lactam bridge between residues 16 and 20
YXQGTFVSDYSIYLDEQAAKEFVNWLLAGGPSSGAPPPSC

SEQ ID NO: 1085 - protein, 40 aa, Artificial sequence
  Synthetic polypeptide
  MISC_FEATURE: Analog 200
  MOD_RES (2)..(2): Xaa is Aib
  MISC_FEATURE (16)..(20): Lactam bridge between residues 16 and 20
  MOD_RES (27)..(27): Xaa is Nle
YXQGTFTSDYSIYLDEQAAKEFVNWLXAGGPSSGAPPPSC

SEQ ID NO: 1086 - protein, 39 aa, Artificial sequence
  Synthetic polypeptide
  MISC_FEATURE: Analog 201
  MOD_RES (2)..(2): Xaa is Aib
YXQGTFTSDYSIYLDEEAVRLFVNWLLAGGPSSGAPPPS

SEQ ID NO: 1087 - protein, 40 aa, Artificial sequence; identical to SEQ ID NO: 1084
  Synthetic polypeptide
  MISC_FEATURE: Analog 202
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1088 - protein, 40 aa, Artificial sequence; identical to SEQ ID NO: 1085
  Synthetic polypeptide
  MISC_FEATURE: Analog 203
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): PEG (40kDa) covalently attached to Cysteine

SEQ ID NO: 1089 - protein, 40 aa, Artificial sequence
  Synthetic polypeptide
  MISC_FEATURE: Analog 204
  MOD_RES (2)..(2): Xaa is Aib
  MISC_FEATURE (16)..(20): Lactam bridge between residues 16 and 20
YXEGTFTSDYSIYLDEQAAKEFVNWLLAGRPSSGAPPPSC

SEQ ID NO: 1090 - protein, 40 aa, Artificial sequence; identical to SEQ ID NO: 1089
  Synthetic polypeptide
  MISC_FEATURE: Analog 205
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1091 - protein, 43 aa, Artificial sequence
  Synthetic polypeptide
  MISC_FEATURE: Analog 206
  MOD_RES (2)..(2): Xaa is Aib
  MISC_FEATURE (16)..(20): Lactam bridge between residues 16 and 20
YXEGTFTSDYSIYLDEQAAKEFVNWLLAGKGKKNWLKHNITQC

SEQ ID NO: 1092 - protein, 43 aa, Artificial sequence
  Synthetic polypeptide
  MISC_FEATURE: Analog 207
  MOD_RES (2)..(2): Xaa is Aib
  MISC_FEATURE (16)..(20): Lactam bridge between residues 16 and 20
YXQGTFTSDYSIYLDEQAAKEFVNWLLAGKGKKNWLKHNITQC

SEQ ID NO: 1093 - protein, 43 aa, Artificial sequence; identical to SEQ ID NO: 1091
  Synthetic polypeptide
  MISC_FEATURE: Analog 208
  MOD_RES (2)..(2): Xaa is Aib
  MISC_FEATURE (16)..(20): Lactam bridge between residues 16 and 20
  MISC_FEATURE (43)..(43): PEG (40kDa) covalently attached to Cysteine

SEQ ID NO: 1094 - protein, 40 aa, Artificial sequence
  Synthetic polypeptide
  MISC_FEATURE: Analog 209
  MOD_RES (2)..(2): Xaa is Aib
  MISC_FEATURE (9)..(12): Lactam bridge between residues 9 and 12
  MISC_FEATURE (16)..(20): Lactam bridge between residues 16 and 20
YXQGTFTSEYSKYLDEQAAKEFVNWLLAGGPSSGAPPPSC

SEQ ID NO: 1095 - protein, 10 aa, Artificial sequence
  Synthetic polypeptide
  MISC_FEATURE: CEX
GPSSGAPPPS

SEQ ID NO: 1096 - protein, 11 aa, Artificial sequence
  Synthetic polypeptide
  MISC_FEATURE (1)..(1): Xaa is any amino acid
XGPSSGAPPPS

SEQ ID NO: 1097 - protein, 8 aa, Artificial sequence
  Synthetic polypeptide
KRNRNNIA

SEQ ID NO: 1098 - protein, 4 aa, Artificial sequence
  Synthetic polypeptide
KRNR

SEQ ID NO: 1099 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation
YXEGTFTSDYSIYLDKQAAXEFVNWLLAGGPSSGAPPPSC

SEQ ID NO: 1100 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation
YXEGTFTSDYSIYLDKQAAXEFVCWLLAGGPSSGAPPPSK

SEQ ID NO: 1101 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1102 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached Lysine
  MISC_FEATURE (40)..(40): C-terminal amidation

SEQ ID NO: 1103 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1104 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation
YXEGTFTSDYSIYLDKQAAXEFVNWLLAGGPSSGAPPPSK

SEQ ID NO: 1105 - protein, 40 aa, Artificial Sequence; identical to SEQ ID NO: 1104
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached Lysine
  MISC_FEATURE (40)..(40): C-terminal amidation

SEQ ID NO: 1106 - protein, 40 aa, Artificial Sequence; identical to SEQ ID NO: 1104
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1107 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLLAGGPSSGAPPPSC

SEQ ID NO: 1108 - protein, 40 aa, Artificial Sequence; identical to SEQ ID NO: 1107
  Synthetic polypeptide
  MOD_RES (2)..(2): Xaa is Aib
  MOD_RES (20)..(20): Xaa is Aib
  MISC_FEATURE (40)..(40): PEG (40kDa) attached to Cysteine
  MISC_FEATURE (40)..(40): C-terminal amidation

SEQ ID NO: 1109 - protein, 40 aa, Artificial Sequence; identical to SEQ ID NO: 1099
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1110 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVCWLLAG

SEQ ID NO: 1111 - protein, 40 aa, Artificial Sequence; identical to SEQ ID NO: 1104
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1112 - protein, 29 aa, Artificial Sequence
  Synthetic polypeptide
  MISC_FEATURE (2)..(2): Xaa is Aib
  MISC_FEATURE (20)..(20): Xaa is Aib
YXQGTFTSDYSIYLDKQAAXEFVNWLLAG

SEQ ID NO: 1113 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): 14 Carbon fatty acyl group covalently attached to Lysine
  MISC_FEATURE (39)..(39): C-terminal amidation
YXEGTFTSDYSIYLDKQAAXEFVKWLLAGGPSSGAPPPS

SEQ ID NO: 1114 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 16 Carbon fatty acyl group covalently attached to Lysine
  MISC_FEATURE (39)..(39): C-terminal amidation

SEQ ID NO: 1115 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 18 Carbon fatty acyl group covalently attached to Lysine
  MISC_FEATURE (39)..(39): C-terminal amidation

SEQ ID NO: 1116 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1117 - protein, 39 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (39)..(39): C-terminal amidation
YXEGTFTSDKSIYLDKQAAXEFVNWLLAGGPSSGAPPPS

SEQ ID NO: 1118 - protein, 39 aa, Artificial Sequence; identical to SEQ ID NO: 1117
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (39)..(39): C-terminal amidation

SEQ ID NO: 1119 - protein, 39 aa, Artificial Sequence; identical to SEQ ID NO: 1117
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (39)..(39): C-terminal amidation

SEQ ID NO: 1120 - protein, 39 aa, Artificial Sequence; identical to SEQ ID NO: 1117
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1121 - protein, 40 aa, Artificial Sequence
  Synthetic polypeptide
  MOD_RES (2)..(2): Xaa is Aib
  MOD_RES (16)..(16): Xaa is Orn
  MOD_RES (20)..(20): Xaa is Aib
  MISC_FEATURE (40)..(40): C-terminal amidation
YXQGTFTSDYSIYLDXQAAXEFVNWLLAGGPSSGAPPPSC

SEQ ID NO: 1122 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is 2,4-diaminobutyric acid
  MOD_RES (20)..(20): Xaa is Aib
  MISC_FEATURE (40)..(40): C-terminal amidation

SEQ ID NO: 1123 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalentaly attached to Lysine
  MISC_FEATURE (40)..(40): C-terminal amidation
YXQGTFTSDYSIYLDKQAAXEFVNWLLAGGPSSGAPPPSK

SEQ ID NO: 1124 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1125 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1126 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1127 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (29)..(29): C-terminal amidation
YXQGTFTSDYSIYLDKQAAXEFVCWLLAG

SEQ ID NO: 1128 - protein, 29 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1129 - protein, 29 aa, Artificial Sequence
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1130 - protein, 29 aa, Artificial Sequence
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1131 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1132 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation
YXQGTFTSDYSIYLDKQAAXEFVCWLLAGGPSSGAPPPSK

SEQ ID NO: 1133 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1134 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1135 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1136 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1137 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1138 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1139 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1140 - protein, 40 aa, Artificial Sequence; identical to SEQ ID NO: 1099
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 1141 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1142 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation
YXQGTFTSDYSIYLDKQAAXEFVCWLMNGGPSSGAPPPSK

SEQ ID NO: 1143 - protein, 40 aa, Artificial Sequence; identical to SEQ ID NO: 1142
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1144 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1145 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1146 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1147 - protein, 40 aa, Artificial Sequence; identical to SEQ ID NO: 1104
  Synthetic polypeptide
  MOD_RES (2)..(2): Xaa is Aib
  MOD_RES (20)..(20): Xaa is Aib
  MISC_FEATURE (40)..(40): 3-SH-propionic acyl group covalently attached to Lysine
  MISC_FEATURE (40)..(40): C-terminal amidation

SEQ ID NO: 1148 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1149 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFSSDYSIYLDKQAAXEFVNWLLAGGPSSGAPPPSC

SEQ ID NO: 1150 - protein, 40 aa, Artificial Sequence
  Synthetic polypeptide
  MOD_RES (2)..(2): Xaa is Aib
  MOD_RES (7)..(7): Xaa is 2-aminobutyric acid
  MOD_RES (20)..(20): Xaa is Aib
  MISC_FEATURE (40)..(40): C-terminal amidation
YXQGTFXSDYSIYLDKQAAXEFVNWLLAGGPSSGAPPPSC

SEQ ID NO: 1151 - protein, 40 aa, Artificial Sequence; identical to SEQ ID NO: 1132
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1152 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1153 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1154 - protein, 40 aa, Artificial Sequence
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): 14 Carbon fatty acyl group covalently attached to d-Lysine
  MISC_FEATURE (40)..(40): C-terminal amidation
YXEGTFTSDYSIYLDKQAAXEFVCWLLAGGPSSGAPPPSX

SEQ ID NO: 1155 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): C-terminal amidation

SEQ ID NO: 1156 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MOD_RES (40)..(40): Xaa is d-Lysine
  MISC_FEATURE (40)..(40): 14 Carbon fatty acyl group covalently attached to Lysine
  MISC_FEATURE (40)..(40): C-terminal amidation

SEQ ID NO: 1157 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): Xaa is d-Lysine
  MISC_FEATURE (40)..(40): C-terminal amidation

SEQ ID NO: 1158 - protein, 39 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (40)..(40): C-terminal amidation
YXEGTFTSDKSIYLDKQAAXEFVCWLLAGGPSSGAPPPS

SEQ ID NO: 1159 - protein, 39 aa, Artificial Sequence; identical to SEQ ID NO: 1158
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1160 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): C-terminal amidation
YXEGTFTSDYSIYLDKQAAXEFVNWLLAGGPSSGAPPPSKC

SEQ ID NO: 1161 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): C-terminal amidation

SEQ ID NO: 1162 - protein, 39 aa, Artificial Sequence; identical to SEQ ID NO: 1158
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (24)..(24): PEG (40kDa) covalently attached to Cysteine
  MISC_FEATURE (39)..(39): C-terminal amidation

SEQ ID NO: 1163 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): PEG (40kDa) covalently attached to Cysteine
  MISC_FEATURE (41)..(41): C-terminal amidation

SEQ ID NO: 1164 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): PEG (40kDa) covalently attached to Cysteine
  MISC_FEATURE (41)..(41): C-terminal amidation

SEQ ID NO: 1165 - protein, 40 aa, Artificial Sequence
  Synthetic polypeptide
  MOD_RES (2)..(2): Xaa is Aib
  MISC_FEATURE (40)..(40): 14 Carbon fatty acyl group covalently attached to Lysine
  MISC_FEATURE (40)..(40): C-terminal amidation
HXQGTFTSDYSKYLDEQAAKEFICWLMNGGPSSGAPPPSK

SEQ ID NO: 1166 - protein, 40 aa, Artificial Sequence; identical to SEQ ID NO: 1100
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1167 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAKEFVNWLLAGGPSSGAPPPSC

SEQ ID NO: 1168 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAQEFVNWLLAGGPSSGAPPPSC

SEQ ID NO: 1169 - protein, 40 aa, Artificial Sequence
  Synthetic polypeptide
  MOD_RES (2)..(2): Xaa is Aib
  MOD_RES (12)..(16): Lactam bridge between residues 12 and 16
  MOD_RES (20)..(20): Xaa is Aib
  MOD_RES (40)..(40): C-terminal amidation
YXQGTFTSDYSKYLDEQAAXEFVNWLLAGGPSSGAPPPSC

SEQ ID NO: 1170 - protein, 10 aa, Artificial Sequence
  Synthetic polypeptide
GPSSGAPPPK

SEQ ID NO: 1171 - protein, 11 aa, Artificial Sequence
  Synthetic polypeptide
  MOD_RES (1)..(1): Xaa is Gly or a small, aliphatic or non-polar or slightly polar amino acid
XGPSSGAPPPK

SEQ ID NO: 1172 - protein, 12 aa, Artificial Sequence
  Synthetic  polypeptide
  MOD_RES (1)..(1): Xaa is Gly or a small, aliphatic or non-polar or slightly polar amino acid
XGPSSGAPPPSK

SEQ ID NO: 1173 - protein, 40 aa, Artificial Sequence; identical to SEQ ID NO: 1167
  Synethic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1174 - protein, 40 aa, Artificial Sequence; identical to SEQ ID NO: 1168
  Synthetic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1175 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is Aib
  MOD_RES (20)..(20): Xaa is Aib
  MISC_FEATURE (40)..(40): C-terminal amidation

SEQ ID NO: 1176 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDEQAAXEFVNWLLAGGPSSGAPPPSC

SEQ ID NO: 1177 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDEQAAXEFVCWLLAG

SEQ ID NO: 1178 - protein, 29 aa, Artificial Sequence
  Synthetic polypeptide
  MISC_FEATURE: C-terminal amidation
  MOD_RES (2)..(2): Xaa is Aib
  MOD_RES (20)..(20): Xaa is Aib
YXQGTFTSDYSIYLDSQAAXEFVCWLLAG

SEQ ID NO: 1179 - protein, 30 aa, Artificial Sequence
  Synthetic polypeptide
  MOD_RES (2)..(2): Xaa is Aib
  MISC_FEATURE (24)..(24): PEG (40kDa) covalently attached to Cysteine
HXEGTFTSDVSSYLEEQAAKEFICWLVKGR

SEQ ID NO: 1180 - protein, 42 aa, Artificial Sequence
  Synthetic polypeptide
  MISC_FEATURE (24)..(24): Substituted amino acid covalently linked to hydrophilic group
YAPGTFISDYSIAMDKIHQQDFVXWLLAQKGKKNWLKHNITQ

SEQ ID NO: 1181 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalentaly linked to hydrophilic group
YXQGTFTSDYSIYLDEQAAKEFVNWLLAGGPSSGAPPPSX

SEQ ID NO: 1182 - protein, 29 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
  misc_feature (29)..(29): Xaa can be any naturally occurring amino acid
YXQGTFTSDYSIYLDEQAAKEFVXWLLAX

SEQ ID NO: 1183 - protein, 39 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLLAGGPSSGAPPPS

SEQ ID NO: 1184 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGGPSSGAPPPSX

SEQ ID NO: 1185 - protein, 29 aa, Artificial Sequence
  Sythetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFISDYSIYLDEQAAKEFVXWLLAG

SEQ ID NO: 1186 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXQGTFISDYSIYLDEQAAKEFVNWLLAGGPSSGAPPPSX

SEQ ID NO: 1187 - protein, 29 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLMNG

SEQ ID NO: 1188 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substitute amino acid covalently linked to hydrophilic group
YXQGTFVSDYSIYLDEQAAKEFVNWLLAGGPSSGAPPPSX

SEQ ID NO: 1189 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): Substituted amino acid covalently linked to hydrophilic group
YXQGTFTSDYSIYLDEQAAKEFVNWLXAGGPSSGAPPPSX

SEQ ID NO: 1190 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGRPSSGAPPPSX

SEQ ID NO: 1191 - protein, 43 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (43)..(43): Substituted amino acid covalently linked to hydrophilic group
YXEGTFTSDYSIYLDEQAAKEFVNWLLAGKGKKNWLKHNITQX

SEQ ID NO: 1192 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXEGTFTSDYSIYLDKQAAXEFVNWLLAGGPSSGAPPPSX

SEQ ID NO: 1193 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXEGTFTSDYSIYLDKQAAXEFVXWLLAGGPSSGAPPPSK

SEQ ID NO: 1194 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substitute amino acid covalently linked to an acyl or alkyl group
  MISC_FEATURE (40)..(40): C-terminal amidation
YXEGTFTSDYSIYLDKQAAXEFVXWLLAGGPSSGAPPPSX

SEQ ID NO: 1195 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to an acyl or alkyl group
  MISC_FEATURE (40)..(40): C-terminal amidation

SEQ ID NO: 1196 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDKQAAXEFVNWLLAGGPSSGAPPPSX

SEQ ID NO: 1197 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to acyl or alkyl group
  MISC_FEATURE (39)..(39): C-terminal amidation
YXEGTFTSDYSIYLDKQAAXEFVXWLLAGGPSSGAPPPS

SEQ ID NO: 1198 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (39)..(39): C-terminal amidation
YXEGTFTSDXSIYLDKQAAXEFVNWLLAGGPSSGAPPPS

SEQ ID NO: 1199 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1200 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (29)..(29): C-terminal amidation
YXQGTFTSDYSIYLDKQAAXEFVXWLLAG

SEQ ID NO: 1201 - protein, 29 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (29)..(29): C-terminal amidation
YXEGTFTSDXSIYLDKQAAXEFVNWLLAG

SEQ ID NO: 1202 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked acyl or alkyl group
  MISC_FEATURE (40)..(40): C-terminal amidation
YXQGTFTSDYSIYLDKQAAXEFVCWLLAGGPSSGAPPPSX

SEQ ID NO: 1203 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLLAGGPSSGAPPPSX

SEQ ID NO: 1204 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXQGTFTSDYSIYLDKQAAXEFVXWLLAGGPSSGAPPPSK

SEQ ID NO: 1205 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation

SEQ ID NO: 1206 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1207 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVCWLMNGGPSSGAPPPSX

SEQ ID NO: 1208 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLMNGGPSSGAPPPSX

SEQ ID NO: 1209 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1210 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1211 - protein, 40 aa, Artificial Sequence; identical to SEQ ID NO: 1202
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1212 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1213 - protein, 40 aa, Artificial Sequence; identical to SEQ ID NO: 1193
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1214 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1215 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1216 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1217 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (40)..(40): C-terminal amidation
YXEGTFTSDXSIYLDKQAAXEFVCWLLAGGPSSGAPPPS

SEQ ID NO: 1218 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): C-terminal amidation
YXEGTFTSDYSIYLDKQAAXEFVNWLLAGGPSSGAPPPSXC

SEQ ID NO: 1219 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (24)..(24): Substituted amino acid covalently linked to hydrophilic group
  MISC_FEATURE (39)..(39): C-terminal amidation
YXEGTFTSDXSIYLDKQAAXEFVXWLLAGGPSSGAPPPS

SEQ ID NO: 1220 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSXX

SEQ ID NO: 1221 - protein, 41 aa, Artificial Sequence
  Synthetic polypeptide
  MOD_RES (2)..(2): Xaa is Aib
  MOD_RES (20)..(20): Xaa is Aib
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSKX

SEQ ID NO: 1222 - protein, 40 aa, Artificial Sequence
  Synthetic polypeptide
  MOD_RES (2)..(2): Xaa is Aib
  MISC_FEATURE (40)..(40): Substituted amino acid covalently linked to acyl or alkyl group
  MISC_FEATURE (40)..(40): C-terminal amidation
HXQGTFTSDYSKYLDEQAAKEFICWLMNGGPSSGAPPPSX

SEQ ID NO: 1223 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1224 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAKEFVNWLLAGGPSSGAPPPSX

SEQ ID NO: 1225 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAQEFVNWLLAGGPSSGAPPPSX

SEQ ID NO: 1226 - protein, 30 aa, Artificial Sequence; identical to SEQ ID NO: 1179
  Synthetic polypeptide
  MOD_RES (2)..(2): Xaa is Aib
  MISC_FEATURE (24)..(24): Substituted amino acid covalently linked to hydrophilic group

SEQ ID NO: 1227 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVNWLLAG

SEQ ID NO: 1228 - protein, 29 aa, Artificial Sequence
  Synthetic polypeptide
  MOD_RES (2)..(2): Xaa is D-Ser, D-Ala, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MISC_FEATURE (29)..(29): C-terminal amidation
YXQGTFTSDYSIYLDXQAAXEFVNWLXXX

SEQ ID NO: 1229 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSKYLDKRRAXDFVQWLLAG

SEQ ID NO: 1230 - protein, 29 aa, Artificial Sequence
  Synthetic polypeptide
  MOD_RES (2)..(2): Xaa is D-Ser, DAla, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MOD_RES (29)..(29): C-terminal amidation
YXQGTFTSDYSKYLDXRRAXDFVQWLXXX

SEQ ID NO: 1231 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MOD_RES (40)..(40): C-terminal amidation
  DISULFID (41)..(41): Disulfide bond formed with Cys residue of a second peptide having the same structure.

SEQ ID NO: 1232 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLMNGGPSSGAPPPSK

SEQ ID NO: 1233 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFISDYSIYLDKQAAXEFVNWLLAGGPSSGAPPPSK

SEQ ID NO: 1234 - protein, 40 aa, Artificial Sequence; identical to SEQ ID NO: 1233
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine
  MISC_FEATURE (40)..(40): C-terminal amidation

SEQ ID NO: 1235 - protein, 40 aa, Artificial Sequence; identical to SEQ ID NO: 1104
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1236 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1237 - protein, 40 aa, Artificial Sequence
  Synthetic polypeptide
  MOD_RES (2)..(2): Xaa is Aib
  MISC_FEATURE (10)..(10): 16 Carbon fatty acyl group covalently bound to Lysine via dipeptide spacer
  MOD_RES (20)..(20): Xaa is Aib
  MISC_FEATURE (40)..(40): C-terminal amidation
YXEGTFTSDKSIYLDKQAAXEFVNWLLAGGPSSGAPPPSK

SEQ ID NO: 1238 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covelently bound to Lysine
  MISC_FEATURE (41)..(41): C-terminal amidation
  MISC_FEATURE (41)..(41): Cys residue covalently attached to 20 kDa PEG which is in turn covalently attached to a Cys residue of a second peptide having the same structure

SEQ ID NO: 1239 - protein, 41 aa, Artificial Sequence; identical to SEQ ID NO: 1160
  Synthetic polypeptide
  MISC_FEATURE: homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MISC_FEATURE (41)..(41): PEG (5kDa) covalently bound to Cysteine
  MISC_FEATURE (41)..(41): C-terminal amidation
  MISC_FEATURE (41)..(41): Cys residue covalently attached to 5 kDa PEG which is in turn covalently attached to a Cys residue of a second peptide having the same structure

SEQ ID NO: 1240 - protein, 29 aa, Artificial Sequence
  Synthetic polypeptide
  MOD_RES (3)..(3): Xaa is a Glutamine analog
  MOD_RES (27)..(27): Xaa is Nle
HSXGTFTSDYSKYLDTRRAAEFVAWLXDE

SEQ ID NO: 1241 - protein, 29 aa, Artificial Sequence
  Synthetic polypeptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 1242 - protein, 29 aa, Artificial Sequence
  Synthetic polypeptide
  MOD_RES (27)..(27): Xaa is Nle
HSQGTFTSDYSKYLDTRRAAEFVAWLXDE

SEQ ID NO: 1243 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 1244 - protein, 29 aa, Artificial Sequence
  Synthetic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 1245 - protein, 29 aa, Artificial Sequence
  Synthetic polypeptide
  MOD_RES (3)..(3): Xaa is carbamoyldiaminopropanoic acid
  MOD_RES (27)..(27): Xaa is Nle
HSXGTFTSDYSKYLDTRRAAEFVAWLXDE

SEQ ID NO: 1246 - protein, 29 aa, Artificial Sequence
  Synthetic polypeptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 1247 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 1248 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 1249 - protein, 29 aa, Artificial Sequence
  Synthetic polypeptide
  MOD_RES (16)..(16): Xaa is Aib
HSQGTFTSDYSKYLDXRRAADFVAWLMDE

SEQ ID NO: 1250 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLMDE

SEQ ID NO: 1251 - protein, 29 aa, Artificial Sequence
  Synthetic polypeptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 1252 - protein, 29 aa, Artificial Sequence
  Synthetic polypeptide
HSQGTFTSDYSKYLDSRRAQDFVQWLMDT

SEQ ID NO: 1253 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLLDE

SEQ ID NO: 1254 - protein, 39 aa, Artificial Sequence; identical to SEQ ID NO: 604
  Synthetic polypeptide
  MOD_RES (3)..(3): Xaa is Acetyldiaminobutanoic acid
  MOD_RES (16)..(16): Xaa is Aib
  MISC_FEATURE (39)..(39): C-terminal amidation

SEQ ID NO: 1255 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRASDFVSWLLDE

SEQ ID NO: 1256 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRATDFVTWLLDE

SEQ ID NO: 1257-1258 - skipped (2 entries)

SEQ ID NO: 1259 - protein, 40 aa, Artificial Sequence
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Ala-Ac-Cys(PEG), wherein the Ac-Cys(PEG) is a Cys residue comprising an alpha amino group capped with an acetyl group (CH3CO) and comprising a 40 kDa PEG covalently attached to its side chain
YXQGTFTSDYSIYLDEQAAKEFVNWLLAGGPSSGAPPPSK

SEQ ID NO: 1260 - protein, 40 aa, Artificial Sequence; identical to SEQ ID NO: 1259
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Arg-Ac-Cys(PEG), wherein the Ac-Cys(PEG) is a Cys residue comprising an alpha amino group capped with an acetyl group (CH3CO) and comprising a 40 kDa PEG covalently attached to its side chain

SEQ ID NO: 1261 - protein, 40 aa, Artificial Sequence; identical to SEQ ID NO: 1071
  Synthetic peptide
  MOD_RES (2)..(2): Xaa is Aib
  MISC_FEATURE (16)..(20): Lactam bridge links Glu16 and Lys20
  MOD_RES (40)..(40): Cys-PEG covalently linked via thioether linkage

SEQ ID NO: 1262 - protein, 40 aa, Artificial Sequence
  Synthetic peptide
  MOD_RES (2)..(2): Xaa is Aib
HXQGTFTSDYSKYLDERRAQDFVQWLMNTGPSSGAPPPSK

SEQ ID NO: 1263 - protein, 40 aa, Artificial Sequence; identical to SEQ ID NO: 1165
  Synthetic peptide
  MISC_FEATURE: MT-345
  MOD_RES (2)..(2): Xaa is Aib
  MOD_RES (40)..(40): Acylated with a C14 fatty acyl group
  MOD_RES (40)..(40): AMIDATION

SEQ ID NO: 1264 - protein, 40 aa, Artificial Sequence; identical to SEQ ID NO: 1165
  Synthetic peptide
  MISC_FEATURE: MT-346
  MOD_RES (2)..(2): Xaa is Aib
  MOD_RES (40)..(40): AMIDATION

SEQ ID NO: 1265 - protein, 40 aa, Artificial Sequence
  Synthetic peptide
  MISC_FEATURE: MT-347
  MOD_RES (2)..(2): Xaa is Aib
  MOD_RES (16)..(16): Xaa is Aib
  MOD_RES (40)..(40): Acylated with a C14 fatty acyl group
  MOD_RES (40)..(40): AMIDATION
HXQGTFTSDYSKYLDXQAAKEFICWLMNGGPSSGAPPPSK

SEQ ID NO: 1266 - protein, 40 aa, Artificial Sequence; identical to SEQ ID NO: 1265
  Synthetic peptide
  MISC_FEATURE: MT-348
  MOD_RES (2)..(2): Xaa is Aib
  MOD_RES (16)..(16): Xaa is Aib
  MOD_RES (40)..(40): AMIDATION

SEQ ID NO: 1267 - protein, 40 aa, Artificial Sequence; identical to SEQ ID NO: 1165
  Synthetic peptide
  MISC_FEATURE: MT-349
  MOD_RES (2)..(2): Xaa is Aib
  MOD_RES (24)..(24): Covalently bound to 40kDa PEG via thioether made by reaction of peptide with haloacetyl-activated PEG
  MOD_RES (40)..(40): Acylated with a C14 fatty acyl group
  MOD_RES (40)..(40): AMIDATION

SEQ ID NO: 1268 - protein, 40 aa, Artificial Sequence; identical to SEQ ID NO: 1165
  Synthetic peptide
  MISC_FEATURE: MT-350
  MOD_RES (2)..(2): Xaa is Aib
  MOD_RES (24)..(24): Covalently bound to 40kDa PEG via thioether made by reaction of peptide with haloacetyl-activated PEG
  MOD_RES (40)..(40): AMIDATION

SEQ ID NO: 1269 - protein, 40 aa, Artificial Sequence; identical to SEQ ID NO: 1265
  Synthetic peptide
  MISC_FEATURE: MT-351
  MOD_RES (2)..(2): Xaa is Aib
  MOD_RES (16)..(16): Xaa is Aib
  MOD_RES (24)..(24): Covalently bound to 40kDa PEG via thioether made by reaction of peptide with haloacetyl-activated PEG
  MOD_RES (40)..(40): Acylated with a C14 fatty acyl group
  MOD_RES (40)..(40): AMIDATION

SEQ ID NO: 1270 - protein, 40 aa, Artificial Sequence; identical to SEQ ID NO: 1265
  Synthetic peptide
  MISC_FEATURE: MT-352
  MOD_RES (2)..(2): Xaa is Aib
  MOD_RES (16)..(16): Xaa is Aib
  MOD_RES (24)..(24): Covalently bound to 40kDa PEG via thioether made by reaction of peptide with haloacetyl-activated PEG
  MOD_RES (40)..(40): AMIDATION

SEQ ID NO: 1271 - skipped

SEQ ID NO: 1272 - protein, 40 aa, Artificial Sequence
  Synthetic peptide
  MISC_FEATURE: MT-361
  MOD_RES (2)..(2): Xaa is Aib
  MOD_RES (16)..(16): Xaa is Aib
  MOD_RES (40)..(40): AMIDATION
HXQGTFTSDYSIYLDXQAAKEFVNWLMNGGPSSGAPPPSK

SEQ ID NO: 1273 - protein, 40 aa, Artificial Sequence; identical to SEQ ID NO: 1272
  Synthetic peptide
  MISC_FEATURE: MT-362
  MOD_RES (2)..(2): Xaa is Aib
  MOD_RES (16)..(16): Xaa is Aib
  MOD_RES (40)..(40): Acylated with a C16 fatty acyl group
  MOD_RES (40)..(40): AMIDATION

SEQ ID NO: 1274 - protein, 40 aa, Artificial Sequence
  Synthetic peptide
  MISC_FEATURE: MT-363
  MOD_RES (2)..(2): Xaa is Aib
  MOD_RES (40)..(40): AMIDATION
HXQGTFTSDYSKYLDEQAAKEFIAWLMNGGPSSGAPPPSK

SEQ ID NO: 1275 - protein, 40 aa, Artificial Sequence; identical to SEQ ID NO: 1274
  Synthetic peptide
  MISC_FEATURE: MT-364
  MOD_RES (2)..(2): Xaa is Aib
  MOD_RES (40)..(40): Acylated with a C16 fatty acyl group
  MOD_RES (40)..(40): AMIDATION

SEQ ID NO: 1276-1300 - skipped (25 entries)

SEQ ID NO: 1301 - protein, 29 aa, Homo sapiens
HSQGTFTSDYSKYLDSRRAQDFVQWLMNT

SEQ ID NO: 1302 - protein, 28 aa, Artificial Sequence
  Synthetic Polypeptide
  MISC_FEATURE: Glucagon analogue
  MISC_FEATURE (8)..(8): Xaa is aspartic acid, glutamic acid, cysteic acid or homocysteic acid
SQGTFTSXYSKYLDSRRAQDFVQWLMNT

SEQ ID NO: 1303 - protein, 27 aa, Artificial Sequence
  Synthetic Polypeptide
  MISC_FEATURE: Glucagon analogue
  MISC_FEATURE (7)..(7): Xaa is aspartic acid, glutamic acid, cysteic acid or homocysteic acid
QGTFTSXYSKYLDSRRAQDFVQWLMNT

SEQ ID NO: 1304 - protein, 26 aa, Artificial Sequence
  Synthetic Polypeptide
  MISC_FEATURE: Glucagon analogue
  MISC_FEATURE (6)..(6): Xaa is aspartic acid, glutamic acid, cysteic acid or homocysteic acid
GTFTSXYSKYLDSRRAQDFVQWLMNT

SEQ ID NO: 1305 - protein, 25 aa, Artificial Sequence
  Synthetic Polypeptide
  MISC_FEATURE: Glucagon analogue
  MISC_FEATURE (5)..(5): Xaa is aspartic acid, glutamic acid, cysteic acid or homocysteic acid
TFTSXYSKYLDSRRAQDFVQWLMNT

SEQ ID NO: 1306 - protein, 24 aa, Artificial Sequence
  Synthetic Polypeptide
  MISC_FEATURE: Glucagon analogue
  MISC_FEATURE (4)..(4): Xaa is glutamic acid, cysteic acid or homocysteic acid
  MISC_FEATURE (22)..(22): Xaa at position 22 is Met, Leu or Nle
FTSXYSKYLDSRRAQDFVQWLXNT

SEQ ID NO: 1307 - protein, 24 aa, Artificial Sequence
  Synthetic Polypeptide
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNT

SEQ ID NO: 1308 - protein, 24 aa, Artificial Sequence
  Synthetic Polypeptide
  MOD_RES (1)..(1): N-terminal amino group replaced with hydroxy group
  MISC_FEATURE (22)..(22): Xaa is  Met, Leu or Nle
  MOD_RES (24)..(24): C-terminal alpha carboxylate replaced with amide
FTSDYSRYLDSRRAQDFVQWLXNT

SEQ ID NO: 1309 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenyalanine
  MISC_FEATURE (22)..(22): Xaa is Met, Leu or Nle
FTSXYSXYLDXRRAQDFVQWLXNT

SEQ ID NO: 1310 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNT

SEQ ID NO: 1311 - protein, 24 aa, Artificial Sequence
  Synthetic Polypetide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDSRRAQDFVXWLXNT

SEQ ID NO: 1312 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenylalanine
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDXRRAQDFVXWLXNT

SEQ ID NO: 1313 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVQWLXNT

SEQ ID NO: 1314 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSKYLDSRRAQDFVCWLXNT

SEQ ID NO: 1315 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): Pegylated
FTSXYSKYLDSRRAQDFVQWLXNC

SEQ ID NO: 1316 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSRYLDSRRAQDFVKWLXNT

SEQ ID NO: 1317 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVCWLXNT

SEQ ID NO: 1318 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): C-terminal alpha carboxylate replaced with amide
FTSXYSKYLECRRAQDFVQWLXNT

SEQ ID NO: 1319 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1320 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1321 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1322 - protein, 24 aa, Artificial Sequence
  Synthetic Polypeptide
  MISC_FEATURE: Glucagon analogue
  MISC_FEATURE (7)..(7): Xaa is Lys or Arg
  MISC_FEATURE (11)..(11): Xaa is Lys, Cys, Orn, homocycstein or acetyl phenyalanine
  MISC_FEATURE (19)..(19): Xaa is Lys, Cys, Orn, homocycstein or acetyl phenyalanine
FTSRYSXYLDXRRAQDFVXWLMNT

SEQ ID NO: 1323 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNTGPSSGAPPPS

SEQ ID NO: 1324 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNRNNIA

SEQ ID NO: 1325 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTGPSSGAPPPS

SEQ ID NO: 1326 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylation
  MISC_FEATURE (22)..(22): Xaa is Met, Leu or Nle
FTSXYSXYLDSRRAQXFVQWLXNTKRNRNNIA

SEQ ID NO: 1327 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylated
  MISC_FEATURE (22)..(22): Xaa is Met, Leu or Nle
FTSXYSXYLDSRRAQXFVQWLXNTKRNR

SEQ ID NO: 1328 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNR

SEQ ID NO: 1329 - protein, 34 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTGPSSGAPPPS

SEQ ID NO: 1330 - protein, 32 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTKRNRNNIA

SEQ ID NO: 1331 - protein, 28 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQCFVQWLXNTKRNR

SEQ ID NO: 1332 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1333 - protein, 39 aa, Artificial Sequence; identical to SEQ ID NO: 36
  Synthetic Polypeptide
  MISC_FEATURE: Glucagon analogue

SEQ ID NO: 1334 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1335 - protein, 29 aa, Artificial Sequence
  Synthetic Polypeptide
  MISC_FEATURE: Glucagon Analogue
  MOD_RES (24)..(24): Carboxymethyl group bound through thiol group of Cysteine
HSQGTFTSDYSKYLDSRRAQCFVQWLMNT

SEQ ID NO: 1336 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLESRRAQDFVQWLXNT

SEQ ID NO: 1337 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLDSRRAQDFVQWLXNT

SEQ ID NO: 1338 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLESRRAQDFVQWLXNT

SEQ ID NO: 1339 - protein, 24 aa, Artificial Sequence
  Synthetic Polypeptide
  MISC_FEATURE: Glucagon analogue
  MISC_FEATURE (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MISC_FEATURE (23)..(23): Xaa is Asn, Asp, Glu, cysteic acid or homocysteic acid
  MISC_FEATURE (24)..(24): Xaa id Thr, Asp, Glu, cysteic acid or homocysteic acid
FTSXYSKYLDSRRAQDFVQWLXXX

SEQ ID NO: 1340 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1341 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn, Asp or Glu
  MISC_FEATURE (24)..(24): Xaa is Thr, glu or Asp
FTSXYSKYLXSRRAQDFVQWLXXX

SEQ ID NO: 1342 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1343 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (11)..(11): 20kDa PEG group attached to Xaa at position 11
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXCRRAQDFVQWLXXX

SEQ ID NO: 1344 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (16)..(16): 20kDa PEG group attached to Xaa at position 16
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQCFVQWLXXX

SEQ ID NO: 1345 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (19)..(19): Pegylated
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVCWLXXX

SEQ ID NO: 1346 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (25)..(25): Xaa is Lys, Cys, Orn, homocycstein or acetyl phenyalanine
  MOD_RES (25)..(25): Pegylated
FTSXYSKYLXSRRAQDFVQWLXXXXGPSSGAPPPS

SEQ ID NO: 1347 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (35)..(35): Xaa is Lys, Cys, Orn, homocysteine or acetyl phenyalanine
  MOD_RES (35)..(35): Pegylated
FTSXYSKYLXSRRAQDFVQWLXXXGPSSGAPPPSX

SEQ ID NO: 1348 - protein, 39 aa, Artificial Sequence; identical to SEQ ID NO: 39
  Synthetic Polypeptide
  MISC_FEATURE: Glucagon analogue

SEQ ID NO: 1349 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (22)..(22): Xaa is Met , Leu or Nle
  MISC_FEATURE (35)..(35): Xaa is Lys, Cys, Orn, homocysteine or acetyl phenyalanine
  MOD_RES (35)..(35): Pegylated
FTSXYSXYLDSRRAQDFVQWLXNTGPSSGAPPPSX

SEQ ID NO: 1350 - protein, 24 aa, Artificial Sequence
  Synthetic Polypeptide
  MISC_FEATURE: Glucagon analogue
  MOD_RES (1)..(1): N-terminal amino group replaced with hydroxy group
FTSEYSKYLDSRRAQDFVQWLMNT

SEQ ID NO: 1351 - protein, 20 aa, Artificial Sequence
  Synthetic Polypeptide
  MISC_FEATURE: Glucagon analogue
YSKYLDSRRAQDFVQWLMNT

SEQ ID NO: 1352 - protein, 24 aa, Artificial Sequence
  Synthetic Polypeptide
  MISC_FEATURE: Glucagon analogue
  MISC_FEATURE (4)..(4): Xaa is Homocysteic acid
FTSXYSKYLDSRRAQDFVQWLMNT

SEQ ID NO: 1353 - protein, 11 aa, Artificial Sequence
  Synthetic Polypeptide
  MISC_FEATURE: Peptide fragment representing the carboxy terminal 10 amino acids of Exendin-4
  MISC_FEATURE (11)..(11): Xaa is Lys, Cys, Orn, homocysteine or acetyl phenyalanine
GPSSGAPPPSX

SEQ ID NO: 1354 - protein, 6 aa, Artificial Sequence
  Synthetic Polypeptide
  MISC_FEATURE (6)..(6): Xaa is phenyl lactic acid
HSQGTX

SEQ ID NO: 1355 - protein, 5 aa, Artificial Sequence
  Synthetic Polypeptide
  MISC_FEATURE (5)..(5): Xaa is phenyl lactic acid
SQGTX

SEQ ID NO: 1356 - protein, 4 aa, Artificial Sequence
  Synthetic Polypeptide
  MISC_FEATURE (4)..(4): Xaa is phenyl lactic acid
QGTX

SEQ ID NO: 1357 - protein, 3 aa, Artificial Sequence
  Synthetic Polypeptide
  MISC_FEATURE (3)..(3): Xaa is phenyl lactic acid
GTX

SEQ ID NO: 1358 - protein, 2 aa, Artificial Sequence
  Synthetic Polypeptide
  MISC_FEATURE (2)..(2): Xaa is phenyl lactic acid
TX

SEQ ID NO: 1359 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1360 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1361 - protein, 4 aa, Artificial Sequence
  Synthetic Polypeptide
  MISC_FEATURE (1)..(1): Xaa is selected from a group consisting of Glu and Gln
  MISC_FEATURE (4)..(4): Xaa is phenyl lactic acid
XGTX

SEQ ID NO: 1362 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate optionally replaced with amide
FTSDYSKYLDSRRAQDFVQWLMDT

SEQ ID NO: 1363 - protein, 28 aa, Artificial Sequence
  Synthetic Polypeptide
  MOD_RES (28)..(28): C-terminal alpha carboxylate optionally replaced with amide
SQGTFTSEYSKYLDSRRAQDFVQWLMNT

SEQ ID NO: 1364 - protein, 28 aa, Artificial Sequence
  Synthetic Polypeptide
  MISC_FEATURE (4)..(5): Threonine in position 4 and phenyl lactic acid in position 5 linked via ester bond
  MISC_FEATURE (5)..(5): Xaa is phenyl lactic acid
  MOD_RES (28)..(28): Optional C-terminal alpha carboxylate replaced with amide
  MOD_RES (28)..(28): C-terminal alpha carboxylate optionally replaced with amide
SQGTXTSEYSKYLDSRRAQDFVQWLMNT

SEQ ID NO: 1365 - protein, 29 aa, Artificial Sequence
  Synthetic Polypeptide
  MISC_FEATURE (5)..(6): Threonine in position 5 and phenyl lactic acid in position 6 linked via ester bond
  MISC_FEATURE (6)..(6): Xaa is phenyl lactic acid
  MOD_RES (29)..(29): C-terminal alpha carboxylate optionally replaced with amide
HSQGTXTSEYSKYLDSRRAQDFVQWLMNT

SEQ ID NO: 1366 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
FTSDYSKYLDXRRAQDFVQWLMNT

SEQ ID NO: 1367 - protein, 24 aa, Artificial Sequence
  Synthetic Polypeptide
  MOD_RES (1)..(1): N-terminal amino group replaced with hydroxy group
FTSDYSKYLDERRAQDFVQWLMNT

SEQ ID NO: 1368 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
XXXTGF

SEQ ID NO: 1369 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
XXTGF

SEQ ID NO: 1370 - protein, 4 aa, Artificial Sequence
  Synthetic Polypeptide
  MISC_FEATURE (1)..(1): Xaa is selected from a group consisting of Glu or Gln
XTGF

SEQ ID NO: 1371 - protein, 24 aa, Artificial Sequence
  Synthetic Polypeptide
  MOD_RES (1)..(1): N-terminal amino group replaced with hydroxy group
  MISC_FEATURE (24)..(24): C-terminal alpha carboxylate optionally replaced with an amide
FTSEYSKYLDSRRAQDFVQWLMNT

SEQ ID NO: 1372-1400 - skipped (29 entries)

SEQ ID NO: 1401 - protein, 29 aa, Homo sapiens
HSQGTFTSDYSKYLDSRRAQDFVQWLMNT

SEQ ID NO: 1402 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMNT

SEQ ID NO: 1403 - protein, 31 aa, Homo sapiens; identical to SEQ ID NO: 50

SEQ ID NO: 1404 - protein, 30 aa, Homo sapiens; identical to SEQ ID NO: 52

SEQ ID NO: 1405 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDERRAQDFVQWLMNT

SEQ ID NO: 1406 - protein, 24 aa, Artificial Sequence
  Synthetic Polypeptide
  MOD_RES (1)..(1): N-terminal amino group replaced with hydroxy group
FTSDYSKYLDERRAKDFVQWLMNT

SEQ ID NO: 1407 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAKDFVEWLMNT

SEQ ID NO: 1408 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAQDFVEWLMKT

SEQ ID NO: 1409 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(7): Xaa at position 7 is Lys or Glu
  MISC_FEATURE (10)..(10): Xaa is Asp, Glu, homoglutamic acid, cysteic acid or homocysteic acid
  MISC_FEATURE (11)..(11): Xaa is Ala, Ser, Glu, Lys, homoglutamic acid or homocysteic acid
  MISC_FEATURE (15)..(15): Xaa is Gln, Glu or Lys
  MISC_FEATURE (19)..(19): Xaa is Ala, Gln, Lys or Glu
  MISC_FEATURE (23)..(23): Xaa is Asn, Lys or an acidic amino acid
  MISC_FEATURE (24)..(24): Xaa is Thr or an acidic amino acid
FTSDYSXYLXXRRAXDFVXWLMXX

SEQ ID NO: 1410 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
  MISC_FEATURE (19)..(19): Xaa is Ala, Gln or Glu
  MISC_FEATURE (23)..(23): Xaa is Asn, Lys or an acidic amino acid
FTSDYSKYLDXRRAXDFVXWLMXT

SEQ ID NO: 1411 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
FTSDYSKYLDXRRAXDFVQWLMNT

SEQ ID NO: 1412 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (15)..(15): Xaa is Lys or Gln
  MISC_FEATURE (16)..(16): Xaa is Lys, Cys, Orn, homocysteine or acetyl phenyalanine
  MOD_RES (16)..(16): Pegylated
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDERRAXXFVXWLXNT

SEQ ID NO: 1413 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (16)..(16): Xaa is Cys, Orn, homocysteine or acetyl phenyalanine
  MOD_RES (16)..(16): Pegylated
  MISC_FEATURE (22)..(22): Xaa is Met, Leu or Nle
FTSXYSKYLDERRAXXFVQWLXNT

SEQ ID NO: 1414 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (19)..(19): Xaa is Cys, Orn, homocysteine or acetyl phenylalanine
  MOD_RES (19)..(19): Pegylated
  MISC_FEATURE (22)..(22): Xaa is Met, Leu or Nle
FTSXYSKYLDERRAXDFVXWLXNT

SEQ ID NO: 1415 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr or an acidic amino acid
FTSXYSXYLXXRRAXDFVXWLXXX

SEQ ID NO: 1416 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAQDFVQWLXXT

SEQ ID NO: 1417 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAKDFVQWLXXT

SEQ ID NO: 1418 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (15)..(19): Lactam bridge connecting residues 15 and 19
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXXRRAKDFVEWLXXT

SEQ ID NO: 1419 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (19)..(23): Lactam bridge connecting residues 19 and 23
  MISC_FEATURE (22)..(22): Xaa is Met, Leu or Nle
  MISC_FEATURE (24)..(24): Xaa is Thr or Glu
  MOD_RES (24)..(24): C-terminal alpha carboxylate replaced with amide
FTSDYSKYLXXRRAQDFVEWLXKX

SEQ ID NO: 1420 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteine
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys, Asp, Glu, cysteic acid or homocysteic acid
  MISC_FEATURE (24)..(24): Xaa is Thr, Asp, Glu, cysteic acid and homocysteic acid
FTSXYSXYLXXRRAXDFVXWLXXX

SEQ ID NO: 1421 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1422 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid and homocysteic acid
  MISC_FEATURE (22)..(22): Xaa is Met, Leu or Nle
FTSXYSKYLXERRAQDFVQWLXNT

SEQ ID NO: 1423 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (11)..(15): Lactam bridge connecting residues 11 and 15
  MISC_FEATURE (22)..(22): Xaa is Met, Leu or Nle
FTSXYSKYLXERRAKDFVQWLXNT

SEQ ID NO: 1424 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (15)..(19): Lactam bridge connecting residues 15 and 19
  MISC_FEATURE (22)..(22): Xaa is Met, Leu or Nle
FTSXYSKYLXERRAKDFVEWLXNT

SEQ ID NO: 1425 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (19)..(24): Lactam bridge connecting residues 19 and 24
  MISC_FEATURE (22)..(22): Xaa is Met, Leu or Nle
FTSXYSKYLXERRAQDFVEWLXKT

SEQ ID NO: 1426 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1427 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1428 - protein, 34 aa, Artificial Sequence
  Synthetic Polypeptide
  MISC_FEATURE: Glucagon analogue
FTSEYSKYLDERRAQDFVQWLMNTGPSSGAPPPS

SEQ ID NO: 1429 - protein, 34 aa, Artificial Sequence; identical to SEQ ID NO: 1428
  Synthetic Polypeptide
  MISC_FEATURE (7)..(11): Lactam bridge connecting residues 7 and 11

SEQ ID NO: 1430 - protein, 34 aa, Artificial Sequence
  Synthetic Polypeptide
  MISC_FEATURE: Glucagon analogue
  MISC_FEATURE (11)..(15): Lactam bridge connecting residues 11 and 15
FTSEYSKYLDERRAKDFVQWLMNTGPSSGAPPPS

SEQ ID NO: 1431 - protein, 34 aa, Artificial Sequence
  Synthetic Polypeptide
  MISC_FEATURE: Glucagon analogue
  MISC_FEATURE (7)..(11): Lactam bridge connecting residues 7 and 11
FTSDYSKYLDERRAQDFVQWLMNTGPSSGAPPPS

SEQ ID NO: 1432 - protein, 34 aa, Artificial Sequence; identical to SEQ ID NO: 1428
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11

SEQ ID NO: 1433 - protein, 34 aa, Artificial Sequence; identical to SEQ ID NO: 1430
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15

SEQ ID NO: 1434 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMDT

SEQ ID NO: 1435 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
FTSEYSKYLDERRAQDFVQWLMNT

SEQ ID NO: 1436 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15
FTSEYSKYLDERRAKDFVQWLMNT

SEQ ID NO: 1437 - protein, 31 aa, Artificial Sequence
  Synthetic Polypeptide
  MISC_FEATURE: Glucagon analogue
HSQGTFTSDYARYLDARRAREFIKWLVRGRG

SEQ ID NO: 1438 - protein, 24 aa, Artificial Sequence
  Synthetic Polypeptide
  MISC_FEATURE: Glucagon analogue
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1439 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MOD_RES (24)..(24): C-terminal alpha carboxylate replaced with amide
FTSXYSKYLXERRAKDFVQWLXNT

SEQ ID NO: 1440 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1441 - protein, 39 aa, Artificial Sequence; identical to SEQ ID NO: 36
  Synthetic Polypeptide
  MISC_FEATURE: Glucagon Analogue

SEQ ID NO: 1442 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1443 - protein, 29 aa, Artificial Sequence
  Synthetic Polypeptide
  MISC_FEATURE: Glucagon Analogue
  MOD_RES (21)..(21): Carboxymethyl group bound through thiol group of Cysteine
HSQGTFTSDYSKYLDSRRAQCFVQWLMNT

SEQ ID NO: 1444 - protein, 39 aa, Homo sapiens
HSQGTFTSDYSRYLDSRRAQDFVQWLRNTGPSSGAPPPS

SEQ ID NO: 1445 - protein, 35 aa, Artificial Sequence; identical to SEQ ID NO: 1346
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (25)..(25): Xaa is Cys, Orn, homocysteine or acetyl phenyalanine
  MOD_RES (25)..(25): Pegylated

SEQ ID NO: 1446 - protein, 35 aa, Artificial Sequence; identical to SEQ ID NO: 1347
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (35)..(35): Xaa is Cys, Orn, homocysteine or acetyl phenyalanine
  MOD_RES (35)..(35): Pegylated

SEQ ID NO: 1447 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid, cysteic acid or homocysteic acid
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
FTSXYSKYLXERRAQDFVQWLXXT

SEQ ID NO: 1448 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid,  cysteic acid or homocysteic acid
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
FTSXYSKYLXERRAKDFVQWLXXT

SEQ ID NO: 1449 - protein, 23 aa, Artificial Sequence
  Synthetic Polypeptide
  MISC_FEATURE: Glucagon analogue
TSDYSKYLDERRAKDFVQWLMDT

SEQ ID NO: 1450 - protein, 11 aa, Artificial Sequence
  Synthetic Polypeptide
  MISC_FEATURE: Peptide fragment representing the carboxy terminal 10 amino acids of Exendin-4 plus one additional amino acid
  MISC_FEATURE (11)..(11): Xaa is selected form the group consisting of Cys, Orn, Lys, homocysteine and acetyl phenyalanine
GPSSGAPPPSX

SEQ ID NO: 1451 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr, Gly or an acidic amino acid
FTSXYSXYLXXRRAXDFVXWLXXX

SEQ ID NO: 1452 - protein, 6 aa, Artificial Sequence
  Synthetic Polypeptide
  MISC_FEATURE (6)..(6): Xaa is phenyl lactic acid
HSQGTX

SEQ ID NO: 1453 - protein, 5 aa, Artificial Sequence
  Synthetic Polypeptide
  MISC_FEATURE (5)..(5): Xaa is phenyl lactic acid
SQGTX

SEQ ID NO: 1454 - protein, 4 aa, Artificial Sequence
  Synthetic Polypeptide
  MISC_FEATURE (4)..(4): Xaa is phenyl lactic acid
QGTX

SEQ ID NO: 1455 - protein, 3 aa, Artificial Sequence
  Synthetic Polypeptide
  MISC_FEATURE (3)..(3): Xaa is phenyl lactic acid
GTX

SEQ ID NO: 1456 - protein, 2 aa, Artificial Sequence
  Synthetic Polypeptide
  MISC_FEATURE (2)..(2): Xaa is phenyl lactic acid
TX

SEQ ID NO: 1457 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1458 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1459 - protein, 4 aa, Artificial Sequence
  Synthetic Polypeptide
  MISC_FEATURE (1)..(1): Xaa is selected from a group consisting of Glu or Gln
  MISC_FEATURE (4)..(4): Xaa is phenyl lactic acid
XGTX

SEQ ID NO: 1460 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1461 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSEYSKYLDSRRAQDFVQWLMNT

SEQ ID NO: 1462 - protein, 24 aa, Artificial Sequence
  Synthetic Polypeptide
  MOD_RES (1)..(1): N-terminal amino group replaced with hydroxy group
  MISC_FEATURE (4)..(7): Lactam bridge connecting residues 4 and 7
  MOD_RES (24)..(24): C-terminal alpha carboxylate replaced with amide
FTSEYSKYLDSRRAQDFVQWLMNT

SEQ ID NO: 1463 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1464 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
AEGTXTSDYSKYLDERRAKDFVQWLMDT

SEQ ID NO: 1465 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1466 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
SQGTXTSDYSKYLDERRAKDFVQWLMDT

SEQ ID NO: 1467 - protein, 24 aa, Artificial Sequence
  Synthetic Polypeptide
  MOD_RES (1)..(1): N-terminal amino group replaced with hydroxy group
  MISC_FEATURE (5)..(5): Covalently linked to a cholesterol acid moiety
  MISC_FEATURE (11)..(15): Lactam bridge connecting residues 11 to 15
  MOD_RES (24)..(24): C-terminal alpha carboxylate replaced with amide
FTSDKSKYLDERRAKDFVQWLMDT

SEQ ID NO: 1468 - protein, 25 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (25)..(25): Covalently linked to a cholesterol acid moiety
  MOD_RES (25)..(25): C-terminal alpha carboxylate replaced with amide
FTSDYSKYLDERRAKDFVQWLMDTK

SEQ ID NO: 1469 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connectiong residues 11 and 15
  MISC_FEATURE (35)..(35): Covalently linked to a cholesterol acid moiety
  MOD_RES (35)..(35): C-terminal alpha carboxylate replaced with amide
FTSDYSKYLDERRAKDFVQWLMDTGPSSGAPPPSK

SEQ ID NO: 1470 - protein, 28 aa, Artificial Sequence
  Synthetic Polypeptide
  MISC_FEATURE (1)..(1): Xaa is amino isobutyric acid
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connectiong residues 15 and 19
  MOD_RES (28)..(28): C-terminal alpha carboxylate replaced with amide
XEGTXTSDYSKYLDERRAKDFVQWLMDT

SEQ ID NO: 1471 - protein, 34 aa, Artificial Sequence; identical to SEQ ID NO: 1428
  Synthetic Polypeptide
  MOD_RES (34)..(34): C-terminal alpha carboxylate replaced with amide

SEQ ID NO: 1472 - protein, 34 aa, Artificial Sequence; identical to SEQ ID NO: 1428
  Synthetic Polypeptide
  MOD_RES (1)..(1): N-terminal amino group replaced with hydroxy group
  MOD_RES (34)..(34): C-terminal alpha carboxylate replaced with amide

SEQ ID NO: 1473 - protein, 34 aa, Artificial Sequence; identical to SEQ ID NO: 1430
  Synthetic Polypeptide
  MISC_FEATURE (11)..(15): Lactam bridge connecting residues 11 and 15
  MOD_RES (34)..(34): C-terminal alpha carboxylate replaced with amide

SEQ ID NO: 1474 - protein, 34 aa, Artificial Sequence; identical to SEQ ID NO: 1430
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (34)..(34): C-termincal alpha carboxylate replaced with amide

SEQ ID NO: 1475 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDERRAQDFVQWLMDT

SEQ ID NO: 1476 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1477 - protein, 24 aa, Artificial Sequence
  Synthetic Polypeptide
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAKDFVEWLMDT

SEQ ID NO: 1478 - protein, 24 aa, Artificial Sequence
  Synthetic Polypeptide
  MOD_RES (1)..(1): N-terminal amino group replaced with hydroxy group
  MISC_FEATURE (19)..(23): Lactam bridge connecting residues 19 and 23
  MOD_RES (24)..(24): C-terminal alpha carboxylate replaced with amide
FTSDYSKYLDERRAQDFVEWLMKT

SEQ ID NO: 1479 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDEQAAKDFIAWLMDT

SEQ ID NO: 1480 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDEQAAKEFIAWLMDT

SEQ ID NO: 1481 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1482 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDEQAAKEFIAWLMDT

SEQ ID NO: 1483 - protein, 29 aa, Artificial Sequence
  Synthetic Polypeptide
  MISC_FEATURE (16)..(20): Lactam bridge connection residues 16 and 20
  MOD_RES (29)..(29): C-terminal alpha carboxylate replaced with amide
HAEGTFTSEYSKYLDERRAKDFVQWLMDT

SEQ ID NO: 1484 - protein, 29 aa, Artificial Sequence
  Synthetic Polypeptide
  MISC_FEATURE (16)..(20): Lactam bridge connecting bridges 16 and 20
  MOD_RES (29)..(29): C-terminal alpha carboxylate replaced with amide
HAEGTFTSEYSKYLDEQAAKEFIAWLMDT

SEQ ID NO: 1485 - protein, 26 aa, Artificial Sequence
  Synthetic Polypeptide
  MISC_FEATURE (13)..(17): Lactam bridge connecting residues 13 and 17
  MOD_RES (26)..(26): C-terminal alpha carboxylate replaced with amide
GTFTSEYSKYLDERRAKDFVQWLMDT

SEQ ID NO: 1486 - protein, 28 aa, Artificial Sequence
  Synthetic Polypeptide
  MISC_FEATURE (5)..(6): Threonine in position 5 and phenyl lactic acid in position 6 linked via ester bond
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1487 - protein, 29 aa, Artificial Sequence
  Synthetic Polypeptide
  MISC_FEATURE (5)..(6): Threonine at position 5 and phenyl lactic acid at position 6 linked via ester bond
  MISC_FEATURE (6)..(6): Xaa is phenyl lactic acid
  MISC_FEATURE (16)..(20): Lactam bridge connecting residues 16 and 20
  MOD_RES (29)..(29): C-terminal alpha carboxylate replaced with amide
HAEGTXTSDYSKYLDERRAKDFVQWLMDT

SEQ ID NO: 1488 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (19)..(19): Pegylated
  MOD_RES (24)..(24): C-terminal alpha carboxylate replaced with amide
FTSDYSKYLDERRAQDFVCWLMDT

SEQ ID NO: 1489 - protein, 35 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (35)..(35): Pegylated
  MOD_RES (35)..(35): C-terminal alpha carboxylate replaced with amide
FTSDYSKYLDERRAQDFVQWLMDTGPSSGAPPPSC

SEQ ID NO: 1490 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSDYSKYLDERRAKDFVCWLMDT

SEQ ID NO: 1491 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPSSGAPPPSC

SEQ ID NO: 1492 - protein, 24 aa, Artificial Sequence
  Synthetic Polypeptide
  MOD_RES (1)..(1): N-terminal amino group replaced with hydroxy group
  MOD_RES (1)..(1): Covalently attached to a C16 fatty acid
  MISC_FEATURE (11)..(15): Lactam bridge connection residues 11 and 15
  MOD_RES (24)..(24): C-terminal alpha carboxylate replaced with amide
FTSDYSKYLDERRAKDFVQWLMDT

SEQ ID NO: 1493 - protein, 24 aa, Artificial Sequence
  Synthetic Polypeptide
  MOD_RES (1)..(1): N-terminal amino group replaced with hydroxy group
  MOD_RES (5)..(5): Linked to a C16 fatty acid via Glu residue
  MISC_FEATURE (11)..(15): Lactam bridge connecting residues 11 and 15
  MISC_FEATURE (15)..(15): Linked to a C16 fatty acid via Glu residue
  MOD_RES (24)..(24): C-terminal alpha carboxylate replaced with amide
FTSDKSKYLDERRAKDFVQWLMDT

SEQ ID NO: 1494 - protein, 24 aa, Artificial Sequence
  Synthetic Polypeptide
  MOD_RES (1)..(1): N-terminal amino group replaced with hydroxy group
  MISC_FEATURE (15)..(15): Linked to C16 fatty acid via Glu residue
  MOD_RES (24)..(24): C-terminal alpha carboxylate replaced with amide
FTSDYSKYLDERRAKDFVQWLMDT

SEQ ID NO: 1495 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Linked to a C16 fatty acid via Glu residue
  MOD_RES (24)..(24): C-terminal alpha carboxylate replaced with amide
FTSDYSKYLDERRAKDFVKWLMDT

SEQ ID NO: 1496 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (24)..(24): Linked to a C16 fatty acid via Glu residue
  MOD_RES (24)..(24): C-terminal alpha carboxylate replaced with amide
FTSDYSKYLDERRAKDFVQWLMDK

SEQ ID NO: 1497 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
  MOD_RES (24)..(24): C-terminal alpha carboxylate replaced with amide
FTSDYSKYLDXRRAQDFVQWLMNT

SEQ ID NO: 1498 - protein, 24 aa, Artificial Sequence
  Synthetic Polypeptide
  MOD_RES (1)..(1): N-terminal amino group replaced with hydroxy group
  MISC_FEATURE (11)..(11)
  MISC_FEATURE (15)..(15): Xaa is alpha isobutyric acid
  MOD_RES (24)..(24): C-terminal alpha carboxylate replaced with amide
FTSDKSKYLDXRRAXDFVCWLMNT

SEQ ID NO: 1499 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1500 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDKSKYLDERRAQDFVCWLMNT

SEQ ID NO: 1501 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1502 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1503 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKEFVQWLMDT

SEQ ID NO: 1504 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDEQAAKEFIAWLMNT

SEQ ID NO: 1505 - protein, 34 aa, Artificial Sequence; identical to SEQ ID NO: 1430
  Synthetic Polypeptide
  MOD_RES (34)..(34): C-terminal alpha carboxylate replaced with amide

SEQ ID NO: 1506 - protein, 24 aa, Artificial Sequence
  Synthetic Polypeptide
  MOD_RES (1)..(1): N-terminal amino group replaced with hydroxy group
  MISC_FEATURE (5)..(5): Linked to a C16 fatty acid via Glu residue
  MISC_FEATURE (7)..(7): Linked to a C16 fatty acid via Glu residue
  MOD_RES (24)..(24): C-terminal carboxylate replaced with amide
FTSDKSKYLDERRAKDFVQWLMDT

SEQ ID NO: 1507 - protein, 6 aa, Artificial Sequence
  Synthetic Polypeptide
  MISC_FEATURE (1)..(1): Xaa1 is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, valine, glycine, N-methyl serine, and aminoisobutyric acid (AIB)
  MISC_FEATURE (3)..(3): Xaa is selected from a group consisting of Glu or Gln
XXXTGF

SEQ ID NO: 1508 - protein, 5 aa, Artificial Sequence
  Synthetic Polypeptide
  MISC_FEATURE (1)..(1): Xaa is selected from a group consisting of Ser, D-serine, D-alanine, valine, glycine, N-methyl serine, and aminoisobutyric acid (AIB)
  MISC_FEATURE (2)..(2): Xaa is selected from a group consisting of Glu or Gln
XXTGF

SEQ ID NO: 1509 - protein, 4 aa, Artificial Sequence
  Synthetic Polypeptide
  MISC_FEATURE (1)..(1): Xaa is selected from a group consisting of Glu or Gln
XTGF

SEQ ID NO: 1510 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDSRRAQDFVQWLMDT

SEQ ID NO: 1511 - protein, 28 aa, Artificial Sequence
  Synthetic Polypeptide
  MOD_RES (28)..(28): C-terminal alpha carboxylate replaced with amide
SQGTFTSEYSKYLDSRRAQDFVQWLMNT

SEQ ID NO: 1512 - protein, 28 aa, Artificial Sequence
  Synthetic Polypeptide
  MISC_FEATURE (4)..(5): Threonine at position 4 and phenyl lactic acid at position 5 linked via ester bond
  MISC_FEATURE (5)..(5): Xaa is phenyl lactic acid
  MOD_RES (28)..(28): C-terminal alpha carboxylate replaced with amide
SQGTXTSEYSKYLDSRRAQDFVQWLMNT

SEQ ID NO: 1513 - protein, 29 aa, Artificial Sequence
  Synthetic Polypeptide
  MISC_FEATURE (5)..(6): Threorine at position 5 and phenyl lactic acid at position 6 linked via ester bond
  MISC_FEATURE (6)..(6): Xaa is phenyl lactic acid
  MOD_RES (29)..(29): C-terminal alpha carboxylate replaced with amide
HSQGTXTSEYSKYLDSRRAQDFVQWLMNT

SEQ ID NO: 1514 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSEYSKYLDERRAKDFVCWLMNT

SEQ ID NO: 1515 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Pegylated via spacer
  MOD_RES (24)..(24): C-terminal alpha carboxylate replaced with amide
FTSDYSKYLDERRAKDFVKWLMDT

SEQ ID NO: 1516 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated via rigid spacer
  MOD_RES (24)..(24): C-terminal alpha carboxylate replaced with amide
FTSDYSKYLDERRAKDFVKWLMDT

SEQ ID NO: 1517 - protein, 35 aa, Artificial Sequence
  Synthetic Polypeptide
  MISC_FEATURE (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPGPGPGPGPC

SEQ ID NO: 1518 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate reaplaced with amide
FTSDYSKYLDERRAKDFVQWLMDGGPSSGAPPPSC

SEQ ID NO: 1519-1600 - skipped (82 entries)

SEQ ID NO: 1601 - protein, 29 aa, Homo sapiens
  MOD_RES (29)..(29): C-terminal amidation
HSQGTFTSDYSKYLDSRRAQDPVQWLMNT

SEQ ID NO: 1602 - protein, 24 aa, Artificial Sequence
  Glucagon analog
  MOD_RES (1)..(1): N-terminal amino group replaced with hydroxy group
FTSDYSKYLDSRRAQDFVQWLMNT

SEQ ID NO: 1603 - protein, 31 aa, Homo sapiens; identical to SEQ ID NO: 50

SEQ ID NO: 1604 - protein, 30 aa, Homo sapiens; identical to SEQ ID NO: 52
  MOD_RES (30)..(30): AMIDATION

SEQ ID NO: 1605 - protein, 28 aa, Homo sapiens
HGEGTFTSDLSKQMEEAVRLFIEWLKNG

SEQ ID NO: 1606 - protein, 37 aa, Homo sapiens; identical to SEQ ID NO: 825

SEQ ID NO: 1607 - protein, 42 aa, Homo sapiens; identical to SEQ ID NO: 1004

SEQ ID NO: 1608 - protein, 33 aa, Homo sapiens
HADGSFSDEMNTILDNLAARDFINWLIQTKITD

SEQ ID NO: 1609 - protein, 49 aa, Homo sapiens
YLYQWLGAPVPYPDPLEPRREVCELNPDCDELADHIGFQEAYRRFYGPV

SEQ ID NO: 1610 - protein, 10 aa, Artificial Sequence
  peptide fragment representing the carboxy terminal 10 amino acids of Exendin-4
GPSSGAPPPS

SEQ ID NO: 1611 - protein, 10 aa, Artificial Sequence
  peptide fragment representing the carboxy terminal 10 amino acids of Exendin-4
  MOD_RES (10)..(10): AMIDATION
GPSSGAPPPS

SEQ ID NO: 1612 - protein, 11 aa, Artificial Sequence
  peptide fragment representing the carboxy terminal 10 amino acids of Exendin-4
  MOD_RES (11)..(11): Pegylation
GPSSGAPPPSC

SEQ ID NO: 1613 - protein, 13 aa, Artificial Sequence
  peptide fragment representing the carboxy terminal 13 amino acids of GIP peptide
KGKKNDWKHNITQ

SEQ ID NO: 1614 - protein, 8 aa, Artificial Sequence
  peptide fragment representing the carboxy terminal 8 amino acids of oxyntomodulin
KRNRNNIA

SEQ ID NO: 1615 - protein, 6 aa, Artificial Sequence
  Glucagon analogue
  MOD_RES (6)..(6): C-terminal amide
HTRGTF

SEQ ID NO: 1616 - protein, 6 aa, Artificial Sequence
  glucagon analogue
  MOD_RES (1)..(1): d-histidine
  MOD_RES (2)..(2): d-threonine
  MOD_RES (3)..(3): d-arginine
  MOD_RES (5)..(5): d-threonine
  MOD_RES (6)..(6): d-phenylalanine
  MOD_RES (6)..(6): C-terminal amidation
XXXGXX

SEQ ID NO: 1617 - protein, 30 aa, Artificial Sequence
  glucagon analogue
  MOD_RES (24)..(24): pegylation
HAEGTFTSDVSSYLEGQAAKEFICWLVKGR

SEQ ID NO: 1618 - protein, 39 aa, Heloderma suspectum
HGEGTFTSDLSKQMEEEAVRLFIEWLKNGGPSSGAPPPS

SEQ ID NO: 1619 - protein, 29 aa, Homo sapiens
YADAIFTNSYRKVLGQLSARKLLQDIMSR

SEQ ID NO: 1620 - protein, 28 aa, Homo sapiens
  MOD_RES (28)..(28): AMIDATION
HSDAVFTDNYTRLRKQMAVKKYLNSILN

SEQ ID NO: 1621 - protein, 27 aa, Homo sapiens
HSDGIFTDSYSRYRKQMAVKKYLAAVL

SEQ ID NO: 1622 - protein, 27 aa, Homo sapiens
  MOD_RES (27)..(27): AMIDATION
HADGVFTSDFSKLLGQLSAKKYLESLM

SEQ ID NO: 1623 - protein, 27 aa, Homo sapiens
  MOD_RES (27)..(27): AMIDATION
HSDGTFTSELSRLREGARLQRLLQGLV

SEQ ID NO: 1624 - protein, 30 aa, Artificial Sequence
  Synthetic peptide
  MOD_RES (2)..(2): Xaa is AIB
  MOD_RES (24)..(24): Cys residue linked to 40kDa PEG via maleimide
  MOD_RES (30)..(30): C-terminal amidation
HXQGTFTSDYSKYLDEQAAKEFICWLMNTN

SEQ ID NO: 1625 - protein, 29 aa, Artificial Sequence
  Synthetic peptide
  MOD_RES (2)..(2): Xaa is AIB
  MISC_FEATURE (24)..(24): Covalently bound to 40K PEG via thioether
  MOD_RES (29)..(29): AMIDATION
HXEGTFTSDYSKYLDEQAAKEFICWLMNT

SEQ ID NO: 1626 - protein, 31 aa, Artificial Sequence
  Synthetic peptide
  MOD_RES (1)..(1): d-lysine
  MOD_RES (2)..(2): Sarcosine (N-methyl glycine)
  MOD_RES (4)..(4): Xaa is AIB
  MOD_RES (24)..(24): Covalently bound to 40kDa PEG via thioether
  MOD_RES (31)..(31): AMIDATION
KGHXEGTFTSDYSKYLDEQAAKEFICWLMNT

SEQ ID NO: 1627 - protein, 31 aa, Artificial Sequence; identical to SEQ ID NO: 1626
  Synthetic peptide
  MOD_RES (1)..(1): d-lysine
  MOD_RES (2)..(2): N-hexyl-glycine
  MOD_RES (4)..(4): Xaa is AIB
  MOD_RES (24)..(24): Covalently bound to 40kDa PEG via maleimide
  MOD_RES (31)..(31): AMIDATION

SEQ ID NO: 1628 - protein, 31 aa, Artificial Sequence
  Synthetic peptide
  MOD_RES (1)..(1): d-lysine
  MOD_RES (2)..(2): N-methyl phenylalanine
  MOD_RES (4)..(4): Xaa is AIB
  MOD_RES (24)..(24): Covalently bound to 40kDa PEG via thioether
  MOD_RES (31)..(31): AMIDATION
KFHXEGTFTSDYSKYLDEQAAKEFICWLMNT

SEQ ID NO: 1629 - protein, 29 aa, Artificial Sequence
  Synthetic peptide
  MOD_RES (2)..(2): Xaa is AIB
  MOD_RES (24)..(24): Covalently bound to 40 kDa PEG via maleimide
HXEGTFTSDYSKYLDEQAAKEFICWLMNT

SEQ ID NO: 1630 - protein, 29 aa, Artificial Sequence
  Synthetic peptide
  MOD_RES (1)..(1): Xaa is DMIA
  MISC_FEATURE (16)..(20): Lactam ring between side chains of amino acids
  MOD_RES (24)..(24): Covalently bound to 40kDa PEG via maleimide
  MOD_RES (29)..(29): C-terminal amidation
XSQGTFTSDKSKYLDERRAKDFVCWLMNT

SEQ ID NO: 1631 - protein, 30 aa, Artificial Sequence
  Synthetic peptide
  MOD_RES (30)..(30): C-terminal amidation
HSQGTFTSDYSKYLDEQAAKEFIAWLMNTN

SEQ ID NO: 1632 - protein, 8 aa, Artificial Sequence
  Synthetic peptide
  MOD_RES (1)..(1): Xaa is Phe, hydroxyl-Phe, Gly, hydroxyl-Gly, Ala, Cys, Ser, Lys, Glu, dehydro-Val, Pro, d-Pro, AIB, 1-aminocyclohexanecarboxylic acid, 1-aminocyclopropanecarboxylic acid, N-Me-AIB, alpha-alpha-diethyl-Gly, hydroxyl-AIB, or d-Lys
  MOD_RES (2)..(2): Xaa is Pro, d-Pro, N-methyl-Gly, N-hexyl-Gly, Azetidine-2-carboxylic acid, N-methyl-Ala, or N-methyl-Phe
  MOD_RES (3)..(3): Xaa is His, d-His, Ala, or N-methyl-His
  MOD_RES (8)..(8): C-terminal amidation
XXXSRGTF

SEQ ID NO: 1633 - protein, 31 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Covalently bound to PEG via 40kDa maleimide
KXHXEGTFTSDYSKYLDEQAAKEFICWLMNT

SEQ ID NO: 1634 - protein, 32 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Cys residue linked to 40kDa PEG via maleimide
  MOD_RES (32)..(32): C-terminal amidation
KXHXQGTFTSDYSKYLDEQAAKEFICWLMNTN

SEQ ID NO: 1635 - protein, 31 aa, Artificial Sequence
  Synthetic peptide
  MOD_RES (1)..(1): d-Lys
  MOD_RES (2)..(2): Xaa is Sar
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KXXSQGTFTSDKSKYLDERRAKDFVCWLMNT

SEQ ID NO: 1636 - protein, 31 aa, Artificial Sequence; identical to SEQ ID NO: 1626
  Synthetic peptide
  MOD_RES (1)..(1): d-Lys
  MOD_RES (2)..(2): N-hexyl-Gly
  MOD_RES (4)..(4): Xaa is AIB
  MISC_FEATURE (26)..(26): Covalently bound to 40K PEG via thioether
  MOD_RES (31)..(31): AMIDATION

SEQ ID NO: 1637 - protein, 32 aa, Artificial Sequence
  Synthetic peptide
  MOD_RES (1)..(1): d-Lys
  MOD_RES (2)..(2): N-hexyl-Gly
  MOD_RES (4)..(4): Xaa is AIB
  MOD_RES (26)..(26): Cys residue linked to 40kDa PEG via maleimide
  MOD_RES (32)..(32): C-terminal amidation
KGHXQGTFTSDYSKYLDEQAAKEFICWLMNTN

SEQ ID NO: 1638 - protein, 31 aa, Artificial Sequence
  Synthetic peptide
  MOD_RES (1)..(1): d-Lys
  MOD_RES (2)..(2): N-hexyl-Gly
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KGXSQGTFTSDKSKYLDERRAKDFVCWLMNT

SEQ ID NO: 1639 - protein, 31 aa, Artificial Sequence; identical to SEQ ID NO: 1628
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Covalently bound to 40kDa PEG via maleimide

SEQ ID NO: 1640 - protein, 32 aa, Artificial Sequence
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Cys residue linked to 40kDa PEG via maleimide
  MOD_RES (32)..(32): C-terminal amidation
KFHXQGTFTSDYSKYLDEQAAKEFICWLMNTN

SEQ ID NO: 1641 - protein, 31 aa, Artificial Sequence
  Synthetic peptide
  MOD_RES (1)..(1): d-Lys
  MOD_RES (2)..(2): N-methyl-Phe
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KFXSQGTFTSDKSKYLDERRAKDFVCWLMNT

SEQ ID NO: 1642 - protein, 27 aa, Artificial Sequence
  Synthetic peptide
HADGVFTSDFSKLLGQLSAKKYLESLM

SEQ ID NO: 1643 - protein, 4 aa, Artificial Sequence
  Synthetic peptide
KRNR

SEQ ID NO: 1644 - protein, 100 aa, Homo sapiens
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 1645 - protein, 32 aa, Homo sapiens
CGNLSTCMLGTYTQDFNKFHTFPQTAIGVGAP

SEQ ID NO: 1646 - protein, 37 aa, Homo sapiens [sequence omitted]

SEQ ID NO: 1647 - protein, 40 aa, Artificial Sequence
  Synthetic peptide
  MOD_RES (2)..(2): Xaa is AIB
  MOD_RES (40)..(40): C-terminal amidation
HXEGTFTSDVSSYLEEQAAKEFIAWLVKGGPSSGAPPPSK

SEQ ID NO: 1648 - protein, 40 aa, Artificial Sequence
  Synthetic peptide
  MOD_RES (2)..(2): Xaa is AIB
  MISC_FEATURE (40)..(40): C-terminal amidation
HXEGTFTSDVSSYLEGQAAKEAIAWLVKGGPSSGAPPPSK

SEQ ID NO: 1649 - protein, 40 aa, Artificial Sequence
  Synthetic peptide
  MOD_RES (1)..(1): D-Ala
  MOD_RES (2)..(2): Xaa is AIB
  MOD_RES (3)..(3): D-Glu
  MOD_RES (5)..(5): D-Thr
  MOD_RES (6)..(6): D-Phe
  MOD_RES (7)..(7): D-Thr
  MOD_RES (8)..(8): D-Ser
  MOD_RES (9)..(9): D-Asp
  MOD_RES (10)..(10): D-Val
  MOD_RES (11)..(11): D-Ser
  MOD_RES (12)..(12): D-Ser
  MOD_RES (13)..(13): D-Tyr
  MOD_RES (14)..(14): D-Leu
  MOD_RES (15)..(15): D-Glu
  MOD_RES (17)..(17): D-Gln
  MOD_RES (18)..(18): D-Ala
  MOD_RES (19)..(19): D-Ala
  MOD_RES (20)..(20): D-Lys
  MOD_RES (21)..(21): D-Glu
  MOD_RES (22)..(22): D-Ala
  MOD_RES (23)..(23): D-Ile
  MOD_RES (24)..(24): D-Ala
  MOD_RES (25)..(25): D-Trp
  MOD_RES (26)..(26): D-Leu
  MOD_RES (27)..(27): D-Val
  MOD_RES (28)..(28): D-Lys
  MOD_RES (31)..(31): D-Pro
  MOD_RES (32)..(32): D-Ser
  MOD_RES (33)..(33): D-Ser
  MOD_RES (35)..(35): D-Ala
  MOD_RES (36)..(36): D-Pro
  MOD_RES (37)..(37): D-Pro
  MOD_RES (38)..(38): D-Pro
  MOD_RES (39)..(39): D-Ser
  MOD_RES (40)..(40): C-terminal amidation
AXEGTFTSDVSSYLEGQAAKEAIAWLVKGGPSSGAPPPSK

SEQ ID NO: 1650 - protein, 40 aa, Artificial Sequence
  Synthetic peptide
  MOD_RES (2)..(2): Xaa is AIB
  MOD_RES (24)..(24): Covalently bound to 40kDa PEG via thioether
  MOD_RES (40)..(40): C-terminal amidation
HXEGTFTSDVSSYLEEQAAKEFICWLVKGGPSSGAPPPSK

SEQ ID NO: 1651-1674 - skipped (24 entries)

SEQ ID NO: 1675 - protein, 40 aa, Artificial Sequence; identical to SEQ ID NO: 1647
  Synthetic peptide
  MOD_RES (1)..(1): D-His
  MOD_RES (2)..(2): Xaa is AIB
  MOD_RES (3)..(3): D-Glu
  MOD_RES (5)..(5): D-Thr
  MOD_RES (6)..(6): D-Phe
  MOD_RES (7)..(7): D-Thr
  MOD_RES (8)..(8): D-Ser
  MOD_RES (9)..(9): D-Asp
  MOD_RES (10)..(10): D-Val
  MOD_RES (11)..(11): D-Ser
  MOD_RES (12)..(12): D-Ser
  MOD_RES (13)..(13): D-Tyr
  MOD_RES (14)..(14): D-Leu
  MOD_RES (15)..(15): D-Glu
  MOD_RES (17)..(17): D-Gln
  MOD_RES (18)..(18): D-Ala
  MOD_RES (19)..(19): D-Ala
  MOD_RES (20)..(20): D-Lys
  MOD_RES (21)..(21): D-Glu
  MOD_RES (22)..(22): D-Phe
  MOD_RES (23)..(23): D-Ile
  MOD_RES (24)..(24): D-Ala
  MOD_RES (25)..(25): D-Trp
  MOD_RES (26)..(26): D-Leu
  MOD_RES (27)..(27): D-Val
  MOD_RES (28)..(28): D-Lys
  MOD_RES (31)..(31): D-Pro
  MOD_RES (32)..(32): D-Ser
  MOD_RES (33)..(33): D-Ser
  MOD_RES (35)..(35): D-Ala
  MOD_RES (36)..(36): D-Pro
  MOD_RES (37)..(37): D-Pro
  MOD_RES (38)..(38): D-Pro
  MOD_RES (39)..(39): D-Ser
  MOD_RES (40)..(40): C-terminal amidation

SEQ ID NO: 1676-1678 - skipped (3 entries)

SEQ ID NO: 1679 - protein, 37 aa, Homo sapiens
HSQGTFTSDYSKYLDSRRAQDFVQWLMNTKRNRNNIA

SEQ ID NO: 1680 - protein, 33 aa, Homo sapiens
HADGSFSDEMNTIIDNLAARDFINWLIQTKITD

The invention claimed is:
1. A compound comprising the structure Q-L-Y;
 wherein Q is a glucagon superfamily peptide having agonist activity at the glucagon receptor, the GIP receptor, the GLP-1 receptor, or a combination thereof;
 Y is a G protein-coupled receptor (GPCR) ligand which activates a G protein-coupled receptor selected from an adrenergic receptor or a nicotinic acetylcholine receptor with an $EC_{50}$ of about 1 µM or less, and has a molecular weight of up to about 1000 daltons; and
 L is a linking group or a bond,
 wherein Q comprises an amino acid sequence at least 50% identical to native glucagon that retains the alpha-helix conformation of the amino acids corresponding to amino acids 12-29 of native glucagon (SEQ ID NO: 1601) or an amino acid sequence at least 50% identical to native GLP-1 that retains the alpha-helix conformation of the amino acids corresponding to amino acids 12-29 of native GLP-1 (SEQ ID NO: 1603);
 wherein L-Y is conjugated to Q at position 10, 20, 24, 30, 37, 38, 39, 40, 41, 32, or 43 of Q.

2. The compound of claim 1, wherein Q exhibits at least 0.1% of the activity of native glucagon-like peptide-1 (GLP-1) at the GLP-1 receptor, Q exhibits at least 0.1% of the activity of native glucagon at the glucagon receptor, or Q exhibits at least 0.1% of the activity of native gastric inhibitory polypeptide (GIP) at the GIP receptor, or a combination thereof.

3. The compound of claim 1, wherein Q has an $EC_{50}$ at the GLP-1 receptor within 10-fold of the $EC_{50}$ of Y at the G protein-coupled receptor, Q has an $EC_{50}$ at the glucagon receptor within 10-fold of the $EC_{50}$ of Y at the G protein-coupled receptor, or Q has an $EC_{50}$ at the GIP receptor within 10-fold of the $EC_{50}$ of Y at the G protein-coupled receptor, or a combination thereof.

4. The compound of claim 1, wherein L is stable in vivo, hydrolyzable in vivo, or metastable in vivo.

5. The compound of claim 4, wherein L comprises an ether moiety, an amide moiety, an ester moiety, an acid-labile moiety, a reduction-labile moiety, an enzyme-labile moiety, a hydrazone moiety, a disulfide moiety, or a cathepsin-cleavable moiety.

6. The compound of claim 1, wherein Q comprises
(I) the amino acid sequence:
$X_1$-$X_2$-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839) with 1 to 3 amino acid modifications thereto,
wherein $X_i$ and/or $X_2$ is a non-native amino acid (relative to SEQ ID NO: 1601) that reduces susceptibility of Q to cleavage by dipeptidyl peptidase IV (DPP-IV),
wherein Z is selected from the group consisting of —COOH, -Asn-COOH, Asn-Thr-COOH, and W—COOH, wherein W is 1 to 2 amino acids or GPSSGAPPPS (SEQ ID NO: 1610),
wherein Q comprises a modification selected from the group consisting of:
(i) a lactam bridge between the side chains of amino acids at positions i and i+4, wherein i is 12, 16, 20 or 24, and
(ii) one, two, three, or all of the amino acids at positions 16, 20, 21, and 24 is substituted with an α,α-disubstituted amino acid; and,
wherein Q exhibits glucagon agonist activity; or,
(II) the amino acid sequence of SEQ ID NO: 1601 and comprises:
(a) at least one amino acid modification selected from the group consisting of:
(i) substitution of Thr at position 29 with a charged amino acid;
(ii) substitution of Thr at position 29 with a charged amino acid selected from the group consisting of Lys, Arg, His, Asp, Glu, cysteic acid, and homocysteic acid;
(iii) substitution at position 29 with Asp, Glu, or Lys;
(iv) substitution at position 29 with Glu;
(v) insertion after position 29 of 1 to 3 charged amino acids;
(vi) insertion after position 29 of Glu or Lys;
(vii) insertion after position 29 of Gly-Lys, or Lys-Lys;
(viii) substitution of Gln at position 3 with an amino acid comprising a side chain of Structure I, II, or III:

Structure I
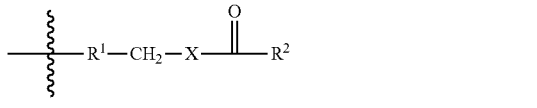

Structure II
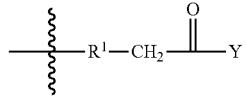

Structure III
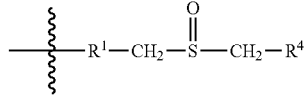

wherein $R^1$ is $C_{0-3}$ alkyl or $C_{0-3}$ heteroalkyl; $R^2$ is $NHR^4$ or $C_{1-3}$ alkyl; $R^3$ is $C_{1-3}$ alkyl; $R^4$ is H or $C_{1-3}$ alkyl; X is NH, O, or S; and Y is $NHR^4$, $SR^3$, or $OR^3$; and
(ix) a combination thereof; and,
(b) substitution of Ser at position 16 with Thr, Glu, or Aib; and at least one amino acid modification selected from the group consisting of:
(i) substitution of His at position 1 with a non-native amino acid that reduces susceptibility of the Q to cleavage by dipeptidyl peptidase IV (DPP-IV),
(ii) substitution of Ser at position 2 with a non-native amino acid that reduces susceptibility of the Q to cleavage by dipeptidyl peptidase IV (DPP-IV),
(iii) substitution of Thr at position 7 with Ile, Abu, or Val;
(iv) substitution of Gln at position 20 with Ser, Thr, Ala, Aib, Arg, or Lys;
(v) substitution of Met at position 27 with Leu or Nle;
(vi) deletion of amino acids at positions 28-29;
(vii) deletion of the amino acid at positions 29;
(viii) addition of the amino acid sequence GPSSGAPPPS (SEQ ID NO: 1610) to the C-terminus;
(ix) addition of the amino acid sequence GPSSGAPPPSX (SEQ ID NO: 1450) to the C-terminus, wherein X is any amino acid; and
(x) a combination thereof; and,
wherein Q exhibits glucagon agonist activity; or,
(III) a glucagon related peptide of SEQ ID NO: 1601, with the following modifications:
(a) an amino acid modification at position 1 that confers GIP agonist activity; and,
(b) a modification selected from the group consisting of:
(i) a lactam bridge between the side chains of amino acids at positions i and i+4 or between the side chains of amino acids at positions j and j+3, wherein i is 12, 13, 16, 17, 20 or 24, and wherein j is 17, and
(ii) one, two, three, or all of the amino acids at positions 16, 20, 21, and 24 is substituted with an α,α-disubstituted amino acid; and,
(c) 1-10 further amino acid modifications; and,
wherein Q exhibits activity at the GIP receptor; or,
(IV) the amino acid sequence:
$X_1$-$X_2$-Gln-Gly-Thr-Phe-Thr-Ser-Asp-$X_3$-Ser-X4-Tyr-Leu-$X_5$-$X_6$-$X_7$-$X_8$-Ala-$X_9$-$X_{10}$-Phe-$X_{11}$-$X_{12}$-Trp-Leu-$X_{13}$-$X_{14}$-$X_{15}$ (SEQ ID NO: 55), or an analog thereof, wherein said analog differs from SEQ ID NO: 55 by 1 to 3 amino acid modifications, selected from positions 1, 2, 3, 5, 7, 10, 11, 13, 14, 17, 18, 19, 21, and 25, wherein:
$X_1$ is His, D-His, (Des-amino)His, hydroxyl-His, acetyl-His, homo-His, or alpha, alpha-dimethyl imidazole acetic acid (DMIA), N-methyl His, alpha-methyl His, or imidazole acetic acid;

$X_2$ is Ser, D-Ser, Ala, D-Ala, Val, Gly, N-methyl Ser, aminoisobutyric acid (Aib) or N-methyl Ala;

$X_3$, $X_4$, $X_5$, $X_{10}$, $X_{11}$, and $X_{14}$ are, individually, any amino acid;

$X_6$ is Ser, Glu, Gln, homoglutamic acid or homocysteic acid;

$X_7$ is Arg, Gln, Lys, Cys, Orn, homocysteine or acetyl phenylalanine;

$X_8$ is Arg, Ala, Lys, Cys, Orn, homocysteine or acetyl phenylalanine;

$X_9$ is Gln, Lys, Arg, Orn or Citrulline;

$X_{12}$ is Ala, Gln, Glu, Lys, Cys, Orn, homocysteine or acetyl phenylalanine;

$X_{13}$ is Met, Leu or Nle;

$X_{15}$ is Thr, Gly, Lys, Cys, Orn, homocycsteine or acetyl phenylalanine; and wherein Q optionally comprises one of the following modifications:
(a) deletion of amino acids at positions 28-29;
(b) deletion of the amino acid at positions 29;
(c) addition of the amino acid sequence GPSSGAPPPS (SEQ ID NO: 1610) to the C-terminus; and
(d) addition of the amino acid sequence GPSSGAPPPSX (SEQ ID NO: 1450) to the C-terminus, wherein X is any amino acid; and
(e) a combination thereof; or, (V) an amino acid sequence that differs from SEQ ID NO: 1601 by no more than ten amino acid modifications, comprising:
(a) one or more amino acid substitutions with Aib at positions 16, 20, 21, and/or 24, and
(b) an amino acid modification at position 1 and/or 2 that provides reduced susceptibility to cleavage by dipeptidyl peptidase IV, and wherein Q optionally comprises one or more of the following modifications:
(i) deletion of amino acids at positions 28 and 29,
(ii) deletion of the amino acid at position 29,
(iii) addition of the amino acid sequence GPSSGAPPPS (SEQ ID NO: 1610) to the C-terminus,
(iv) addition of the amino acid sequence GPSSGAPPPSX (SEQ ID NO: 1450) to the C-terminus, wherein X is any amino acid,
(v) substitution of the C-terminal carboxyl group with an amide or carboxylic ester, and wherein Q exhibits GLP-1 agonist activity and glucagon agonist activity.

7. The compound of claim 6, wherein in (I) the 1-10 further amino acid modifications are selected from the group consisting of:
(i) substitution of serine at position 2 with D-Ser, Ala, D-Ala, Gly, N-methyl-Ser, Aib, Val, or ε-amino-N-butyric acid;
(ii) substitution of serine at position 16 with Glu, Gln, homoglutamic acid, homocysteic acid, Thr, Gly, or Aib;
(iii) substitution of glutamine at position 20 with Ser, Thr, Ala, Lys, Citrulline, Arg, Orn, or Aib;
(iv) substitution of methionine at position 27 with Leu;
(v) substitution of arginine at position 28 with Ala;
(vi) substitution of threonine at position 29 with Gly;
(vii) a conservative substitution at any of positions 2, 5, 9, 10, 11, 12, 13, 14, 15, 16, 17, 18, 20, 21, 24, 27, 28, and 29;
(viii) addition of 1-21 amino acids to the C-terminus
(ix) addition of the amino acid sequence GPSSGAPPPS (SEQ ID NO: 1610) to the C-terminus,
(x) addition of the amino acid sequence GPSSGAPPPSX (SEQ ID NO: 1450) to the C-terminus, wherein X is any amino acid,
(xi) substitution of the C-terminal carboxyl group with an amide or carboxylic ester, and
(xii) a combination thereof.

8. The compound of claim 1, wherein L-Y is covalently conjugated to the N-terminus, C-terminus, or an amino acid side chain of Q that corresponds to position 10, 30, 37, 38, 39, 40, 41, 42, or 43 of native glucagon (SEQ ID NO: 1601) or a peptide comprising native glucagon.

9. A prodrug of the compound claim 1 comprising the structure A-B, wherein
A is an amino acid or a hydroxy acid;
B is an N-alkylated amino acid linked to Q through an amide bond between a carboxyl moiety of B and an amine of Q;
A, B, or the amino acid of Q to which A-B is linked is a non-coded amino acid, further wherein the chemical cleavage half-life ($t_{1/2}$) of A-B from Q is at least about 1 hour to about 1 week in PBS under physiological conditions.

10. The compound of claim 9, wherein A-B comprises the structure:

wherein
(a) $R^1$, $R^2$, $R^4$ and $R^8$ are independently selected from the group consisting of H, C1-C18 alkyl, C2-C18 alkenyl, (C1-C18 alkyl)OH, (C1-C18 alkyl)SH, (C2-C3 alkyl)SCH$_3$, (C1-C4 alkyl)CONH$_2$, (C1-C4 alkyl)COOH, (C1-C4 alkyl)NH$_2$, (C1-C4 alkyl)NHC(NH$_2^+$)NH$_2$, (C0-C4 alkyl)(C3-C6 cycloalkyl), (C0-C4 alkyl)(C2-C5 heterocyclic), (C0-C4 alkyl)(C6-C10 aryl)R$^7$, (C1-C4 alkyl)(C3-C9 heteroaryl), and C1-C12 alkyl(W1)C1-C12 alkyl, wherein W1 is a heteroatom selected from the group consisting of N, S and O, or
(i) $R^1$ and $R^2$ together with the atoms to which they are attached form a C3-C12 cycloalkyl or aryl; or
(ii) $R^4$ and $R^8$ together with the atoms to which they are attached form a C3-C6 cycloalkyl;
(b) $R^3$ is selected from the group consisting of C1-C18 alkyl, (C1-C18 alkyl)OH, (C1-C18 alkyl)NH$_2$, (C1-C18 alkyl)SH, (C0-C4 alkyl)(C3-C6)cycloalkyl, (C0-C4 alkyl)(C2-C5 heterocyclic), (C0-C4 alkyl)(C6-C10 aryl)R$^7$, and (C1-C4 alkyl)(C3-C9 heteroaryl) or $R^4$ and $R^3$ together with the atoms to which they are attached form a 4, 5 or 6 member heterocyclic ring;
(c) $R^5$ is NHR$^6$ or OH;
(d) $R^6$ is H, C1-C8 alkyl or $R^6$ and $R^2$ together with the atoms to which they are attached form a 4, 5 or 6 member heterocyclic ring; and
(e) $R^7$ is selected from the group consisting of H and OH.

11. The compound of claim 1, further comprising an amino acid side chain on Q covalently attached to an acyl group or an alkyl group via an alkyl amine, amide, ether, ester, thioether, or thioester linkage, which acyl group or alkyl group is non-native to a naturally occurring amino acid.

12. The compound of claim 11, wherein the amino acid to which the acyl or alkyl group is attached is at a position corresponding to position 10, 20, 24, 30, 37, 38, 39, 40, 41, 32, or 43, or the C-terminal amino acid.

13. The compound of claim 12, wherein the acyl group or the alkyl group is attached to the side chain of the amino acid through a spacer.

14. The compound of claim 1, wherein Q is covalently attached to one or more heterologous moieties.

15. The compound of claim 1 wherein Q is selected from the group consisting of SEQ ID NOs: 1-564, 566-570, 573-575, 577, 579-580, 585-612, 616, 618-632, 634-642, 647, 657-692, 694-695, 715-718, 722, 724-725, 729, 731-760, 801-878, 883-919, 1001-1275, 1301-1371, 1401-1518, and 1601-1650.

16. A pharmaceutical composition comprising the compound of claim 1 and a pharmaceutically acceptable carrier.

17. A method for treating a disease or medical condition in a patient, wherein the disease or medical condition is selected from the group consisting of metabolic syndrome, diabetes, obesity, liver steatosis, and a neurodegenerative disease, comprising administering to the patient the pharmaceutical composition of claim 16 in an amount effective to treat the disease or medical condition.

18. The compound of claim 1 wherein Y is a β3 adrenergic receptor agonist.

19. The compound of claim 18 wherein the β3 adrenergic receptor agonist is solabegron (3'-[(2-{[R2R)-2-(3-chlorophenyl)-2-hydroxyethyl]amino}ethyl)amino]biphenyl-3-carboxylic acid).

20. The compound of claim 18 wherein Q is exendin-4 (SEQ ID NO: 1618).

21. The compound of claim 1 wherein the G protein-coupled receptor ligand activates the G protein-coupled receptor with an $EC_{50}$ of about 100 nM or less.

* * * * *